United States Patent 7,745,391 (HUMAN THROMBOSPONDIN POLYPEPTIDE) - sequence listing, part 89

SEQ ID NO: 296492 - DNA, 5760 bp, Homo sapiens
gcggctgccgggcctccaatctcggcggcggcggcggcaacaggggagcctgggtctcgcggcctgcgagtccgtcgcgtgctgagggagacgcaggaggtggagccggccgggtgctcgagggaaggagactggaagctggttccggcgtgaggagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatacagctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttctaaaaaaaaaaagaaaa

SEQ ID NO: 296493 - DNA, 4693 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgta

SEQ ID NO: 296494 - DNA, 5284 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatacagctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttctaaaaaaaaaaagaaaa

SEQ ID NO: 296495 - DNA, 5673 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatcttggcagctggcaagccacagtggtgtctgctgggtggctctgggttcctggacctcattcaacataatgcactgaccaaacagctctgaccacagctactctcaaagaggtgcctgccaggtctccctctgacacacacacatacacacactacccactcttggaacccacgatgcactgctggcgggatcctct

SEQ ID NO: 296496 - DNA, 4484 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgta

SEQ ID NO: 296497 - DNA, 2889 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatacagctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttctaaaaaaaaaaagaaaa

SEQ ID NO: 296498 - DNA, 3689 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggaagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgta

SEQ ID NO: 296499 - DNA, 3587 bp, Homo sapiens
  misc_feature (3397)..(3397): n is a, c, g, or t
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctctttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctcaangccaacttagggggaaaaaaattcaacccggggagagaaacgggaaaggaaagcaagaatgggcgtccagactatggaccagggcgtgtaatactttgacgtgacaagctgctcagcggtggtgtcaggcatacggaaactatgacctatgcgcgtatttcatgcattatatacgctactaggtaatttt

SEQ ID NO: 296500 - DNA, 929 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgaagcattgtttttgttttgtttttctaatatgttggcgccatgaaaatcatcatgttcaaatattagtagtaataaaggtgatatgcctggcaaaaaaaa

SEQ ID NO: 296501 - DNA, 1770 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattgtcatacatctctggtataagcaacatttgatttttgaagtgtgtatgaccatctcttcatattttcatagatgtaattttacatttttgcatttgatcagacagtattggccataatcctagatgcacgcttctattattgtacctgcatcaacttctcgaattcggaacctctggcgctccct

SEQ ID NO: 296502 - DNA, 940 bp, Homo sapiens
attttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaatattttac

SEQ ID NO: 296503 - DNA, 542 bp, Homo sapiens
ttgtagttcacagataaggaacagactgaagtagcatactcagggtttcactgctggtacgttgtggggctggggctcacatttggctctttggcctcttagctcaatattattttcgcccccacagcgattctgttcttattttgtgctctcagactattctccaaatggacttacctggagtcacctgtgtcctgtcaccgtggtgggatgcagtcttctcccagttggagtggtgaaggagggggtactggtggaactggaactctaagctagcagcccaaattgctcttggcagcagaagagaagagtaattgtgacatagattctcattttcctttaaactttaaatccctaggcaatgagaagagctatctccaggaacactgccatgctcgtctgttctaccccacagtttcctcatggtgtaatagatcctgtccctgaagtggccaaggtatatgagagaaatgggctgctaaggcaggcaaatggatattttaaaacaaagcctaatggggcagtacttggcaaatagaagc

SEQ ID NO: 296504 - DNA, 176 bp, Homo sapiens
tggaagtatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgt

SEQ ID NO: 296505 - DNA, 314 bp, Homo sapiens
ggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttggtgagccttttgcagacatcctcctggttccaaggcatttgtctccgtttttttagtccaaaggatcccagtgtgtagatttcacctctgat

SEQ ID NO: 296506 - DNA, 2301 bp, Homo sapiens
acaaaaggaggaaggacagcacagctgacagccgtgctcagaaagtttctggatcccaggctcatctccacagaggagaacacgcaggcagcagagaccatggggcccatctcagccccttcctgcagatggcgcatcccctggcaggggctcctgctcacagcctcacttttcaccttctggaacccgcccaccactgctcagctcactattgaagctgtgccatccaatgctgcagaggggaaggaggttcttctacttgtccacaatctgccccaggaccctcgtggctacaactggtacaaaggggaaacagtggatgccaaccgtcgaattataggatatgtaatatcaaatcaacagattaccccagggcctgcatacagcaatcgagagacaatataccccaatgcatccctgctgatgcggaacgtcaccagaaatgacacaggatcctacaccctacaagtcataaagctaaatcttatgagtgaagaagtaactggccagttcagcgtacatccggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctgatgctttagtacaaggaagttctcctggcctctcagctagagccactgtcagcatcatgattggagtactggccagggtggctctgatatagtagctctggtgtagtttctgcatttcaagaagactggcagacagttgtttttattcttcctcaaagcatttgcaatcagctaccattcaaaattgcttcttcttcaagatttatggaaaatactctgacgagtactcttgaacacaagttcctgataactttaagatcacgccactggactgtctatgaacttgcaaacaggctgatacctttgtgaagttgcccaccaaaacacagaaggaaaaaaacatgaatttcattgaactaaataataatgaggataatgtttttaagattttttttttttttttttttgagatggaatctcgctctgtcgcccaggctggagtgcagtggcacgatctcaactcactgcaacgtccgcctcctgggttcacaccattctcctgcctcagcctcctgagtagctgggactacaggcgcctgccacaacgcccggctaattttttgtatttttagtagagacggggtttcactgtggtctcaatctcctgacttcatggtccgcctgcctcagcctcccaaagttctgggattacaggtgtgagccaccgcgcccagcccgtttttaagattttttatttgaaaaattgccaattctttaagtgttttctttttcagatttatgaatttctttatcttttaagctatctataccttactgcaatttggtaaagcagacttttgtgaacaaaaattataacatttacttttgctccctacctgactgccacagaactgggcaactattcatgagtattcatatgtttatggtaattcagttatttgcacaagttcagtgagaatctgctgtctttataatgggatatagtttaaaacattggttatattaccaaggctttgattgggatgttatatttgagaaaatacagagaatgatagattaacggagtgtctaatctatcgtgtcaaccccaaatttttacgtatgagatcctttagtccacccaatggctgacagtaacagcatctttaacacaactctttgttcaaatgtactatggtctcttttagagtcagactcctagactcacttgttctcactgtctgttttaatttaacccaggcatgcaatgctagataataaaattgctccctattggctgatca

SEQ ID NO: 296507 - DNA, 1868 bp, Homo sapiens
cacactgggtcgatgtcgagaccagtctcgtcacacgggaaactcacctggccacagcaggactacatgtcaagacaatcacagtctctgcggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctgatgctttagtacaaggaagttctcctggcctctcagctagagccactgtcagcatcatgattggagtactggccagggtggctctgatatagtagctctggtgtagtttctgcatttcaagaagactggcagacagttgtttttattcttcctcaaagcatttgcaatcagctaccattcaaaattgcttcttcttcaagatttatggaaaatactctgacgagtactcttgaacacaagttcctgataactttaagatcacgccactggactgtctatgaacttgcaaacaggctgatacctttgtgaagttgcccaccaaaacacagaaggaaaaaaacatgaatttcattgaactaaataataatgaggataatgtttttaagattttttttttttttttttttgagatggaatctcgctctgtcgcccaggctggagtgcagtggcacgatctcaactcactgcaacgtccgcctcctgggttcacaccattctcctgcctcagcctcctgagtagctgggactacaggcgcctgccacaacgcccggctaattttttgtatttttagtagagacggggtttcactgtggtctcaatctcctgacttcatggtccgcctgcctcagcctcccaaagttctgggattacaggtgtgagccaccgcgcccagcccgtttttaagattttttatttgaaaaattgccaattctttaagtgttttctttttcagatttatgaatttctttatcttttaagctatctataccttactgcaatttggtaaagcagacttttgtgaacaaaaattataacatttacttttgctccctacctgactgccacagaactgggcaactattcatgagtattcatatgtttatggtaattcagttatttgcacaagttcagtgagaatctgctgtctttataatgggatatagtttaaaacattggttatattaccaaggctttgattgggatgttatatttgagaaaatacagagaatgatagattaacggagtgtctaatctatcgtgtcaaccccaaatttttacgtatgagatcctttagtccacccaatggctgacagtaacagcatctttaacacaactctttgttcaaatgtactatggtctcttttagagtcagactcctagactcacttgttctcactgtctgttttaatttaacccaggcatgcaatgctagataataaaattgctccctattggctgatca

SEQ ID NO: 296508 - DNA, 1831 bp, Homo sapiens
cccgccaccaccacgcagaacgcgcctaatattaggcgcgttctgcgtacatccggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctgatgctttagtacaaggaagttctcctggcctctcagctagagccactgtcagcatcatgattggagtactggccagggtggctctgatatagtagctctggtgtagtttctgcatttcaagaagactggcagacagttgtttttattcttcctcaaagcatttgcaatcagctaccattcaaaattgcttcttcttcaagatttatggaaaatactctgacgagtactcttgaacacaagttcctgataactttaagatcacgccactggactgtctatgaacttgcaaacaggctgatacctttgtgaagttgcccaccaaaacacagaaggaaaaaaacatgaatttcattgaactaaataataatgaggataatgtttttaagattttttttttttttttttttgagatggaatctcgctctgtcgcccaggctggagtgcagtggcacgatctcaactcactgcaacgtccgcctcctgggttcacaccattctcctgcctcagcctcctgagtagctgggactacaggcgcctgccacaacgcccggctaattttttgtatttttagtagagacggggtttcactgtggtctcaatctcctgacttcatggtccgcctgcctcagcctcccaaagttctgggattacaggtgtgagccaccgcgcccagcccgtttttaagattttttatttgaaaaattgccaattctttaagtgttttctttttcagatttatgaatttctttatcttttaagctatctataccttactgcaatttggtaaagcagacttttgtgaacaaaaattataacatttacttttgctccctacctgactgccacagaactgggcaactattcatgagtattcatatgtttatggtaattcagttatttgcacaagttcagtgagaatctgctgtctttataatgggatatagtttaaaacattggttatattaccaaggctttgattgggatgttatatttgagaaaatacagagaatgatagattaacggagtgtctaatctatcgtgtcaaccccaaatttttacgtatgagatcctttagtccacccaatggctgacagtaacagcatctttaacacaactctttgttcaaatgtactatggtctcttttagagtcagactcctagactcacttgttctcactgtctgttttaatttaacccaggcatgcaatgctagataataaaattgctccctattggctgatca

SEQ ID NO: 296509 - DNA, 336 bp, Homo sapiens
ggacactgtggctcttccacagaccaggagcttccccttccctctgatgacatcacctgtgactttattcttttgctctagatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctg

SEQ ID NO: 296510 - DNA, 724 bp, Homo sapiens
ccgaaagtttctatttcttgtataaactcctacatcaaaaattgataaaacaatatgaaagcatgttttctgttattagtttcatagtcagcaaatattaagtttttatatagcattaataaaaaataattattttctatatatagctgtaaacaaaataaaattaaagcactatataaattaaaacaaattgcagtcagcatggaggaatgccacattctgaaacagcaaactcaattattctgcagcaattctgcaactgaaacaaatggaaaagctggatgcaggtactagaaagtttgagacaaccagagagcttccaagacagtgaagctgtgcggagctaaattccagagaaaagggaaggaccaaaaccaacaaatatctagaataaatctaacaaatatggataagatttctattcagtacattatacaacattatagagaaacattagagaatacctaagtaaacagatgggcctaccatgtgcatagattggaagactcaatattataaaaatgtcagttctcccctaggtgatctatagattcaaggcaatccaaataaaaattctagcaggatttgtttgtgtaaaccggcaaactgactctaaaatttaaatggaagtgcaaaaggtcaataactaccaagaaatttcaaagaacaaacttagaggaattgtttttcctagatataaagacttataacaaaactatattag

SEQ ID NO: 296511 - DNA, 444 bp, Homo sapiens
ccggcgcgggagagggctaggtagcctctggcagtcagtctgctcccggccgtgaagccagcacctccgccagcccaccaccagttccttctcctgggctccctcctggccctccaccaagcggcaacatctcccaggacaaaggacacaggatcaggacagcaaggttccaggaggatgagacagaggttccaggaagttatgtccggcaaagcgagcttcatcccccagctcttcctcaattctgagagagatgaaccacaaaggaagtggtcagggatgcaggaggatcctgcttctctctctaggggtcccccagactccaaccacccccacaccacctgcttttgtgtcctgccccaaggcttagcattccctggctttcccatgtgatctctgggatttgtcaatcaggccatcaataaacccaggaagcaaaaacca

SEQ ID NO: 296512 - DNA, 1382 bp, Homo sapiens
ctttacagtcagaggttcatttcctcttcttaacaccaaaaaaaaaaaactctggtgggtctaggcgcggatcggacccaagcaggtcggcggcggcggcaggagagcggccgggcgtcagctcctcgacccccgtgtcgggctagagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296513 - DNA, 872 bp, Homo sapiens
acacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296514 - DNA, 654 bp, Homo sapiens
  misc_feature (176)..(176): n is a, c, g, or t
cgtcattgagaatgagtagctaatcacaggaaagcgccaggagctggtcaccaagattatcaaatgaagaggacatcctctccatgttctcagctatccgttctgagccaaggtgcctgcactttgctgtggcaggcagattgggtggtagtgggaggttgtgcatggaggccagngaaagctgacatcaggacatggtcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtttaaacccgagatgtggcgcggtgtttttacgtcttagacccccgacacattcagatgaaacatccaataagcccccgagcagggaactaaggactggggagctcttctttccttccaaccttataggta

SEQ ID NO: 296515 - DNA, 1602 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296516 - DNA, 1765 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaaaaaaaaacactggatgagagaaagaaacggacagaaggcgacaatacaaatacagggggggcccttcgaagaacagaccgacccaggggggtcaaaaaacgaaggactgccaccaacagtcttgagacacagggggcgcacaaaggagaaggaggacaacagg

SEQ ID NO: 296517 - DNA, 1509 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296518 - DNA, 2222 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacggtgaggctgtggcctagccctggtgggcacagggtggcgcaggccctccccacccacacacaccgttcaggaagcccatgttcagaatgtgccgctcagagctcctgggagtggactgggcacagaactgggtgctgctgctccaggcatggccctatgcagcccttcatttcctcatttcactgatccaggagccaacgaccagacttagactttgagctgggagggggctgacctgagggaaagcaagggactgtgggaaaccaggtgcacagtggctggaaaccgggactctgggctcttctcttgaaggccgcatgatcgtgagcgagtcactgaacctccctaagcctcggccttctcacttgtgaaaaggagatgatgagcttttcagggacacttttttgtaaaacgtttacctgacatataggaaaggctctgtagatggtaggtatcattgtggtcactgccagtggcagcttcggagggaggaggccgctgccggatatcaggcagccatcactgtgaagctggggttctgtggcctccatcctctcccctcgacctccccaagacctggcaaagctcagcccctgagaaggccctctctgttggcccagtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296519 - DNA, 1456 bp, Homo sapiens
ctttacagtcagaggttcatttcctcttcttaacaccaaaaaaaaaaaactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtccagcagggactgaaggtggtgggctgcgcccgcactgtgggcaacatcgagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296520 - DNA, 1985 bp, Homo sapiens
  misc_feature (1701)..(1701): n is a, c, g, or t
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaaaaaaaaaaaaaaaaaaaaaaaaaaaaaaaaaaaaaaaaaaaaaaaaaaaaataaaaagaaaaaataaaaaacaaaaaaatataaaacaagaaatacagngatatagaaagatacaaccagtgacgacggtactactcgagcttattcattggtatggaatcaattgattagaacatgataagaaatcagcagactcaggatgtcagacgacctaactacgacataggctacgaaacagatcaagtcatctaggcggccaaagtataaagtaggatggaataagtactactaaatagttatagatgattactatttctatcagtattaatacaaacatctagatatgtaaggcgaatagtgattaaaacatacgtttttacttt

SEQ ID NO: 296521 - DNA, 1523 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296522 - DNA, 1473 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296523 - DNA, 852 bp, Homo sapiens
ccttcagactccactcttccagcctttgtggctcctcctggagggttggggtggatgtgtggatgccacagagaagctcagtggtgggagggaatttgagtccattctgtccttgtctcaacccattcccctggtgctctcagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 296524 - DNA, 761 bp, Homo sapiens
ggcggggcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaattagacttagcacctcacagatgcttgggcctggaaatgaagccatgaaaatgaagccctcagccttcttggagatcagagccatggtcctcacccacagcacatgggtctctaaacctggacctcaactcgcccatctgtaaaatgaggaacttacattaaattcctacagctcctttcagcttga

SEQ ID NO: 296525 - DNA, 805 bp, Homo sapiens
actggtctccctggaacttcattctctcctctttccccttcctctccccacccagcatgtctggccaccgagtgttacccctgtctgtgacccacttctatagtgccaccaagtatgccgtcactgcgctgacagagggactgaggcaagagcttcgggaggcccagacccacatccgagccacggtgaggctgtggcctagccctggtgggcacagggtggcgcaggccctccccacccacacacaccgttcaggaagcccatgttcagaatgtgccgctcagagctcctgggagtggactgggcacagaactgggtgctgctgctccaggcatggccctatgcagcccttcatttcctcatttcactgatccaggagccaacgaccagacttagactttgagctgggagggggctgacctgagggaaagcaagggactgtgggaaaccaggtgcacagtggctggaaaccgggactctgggctcttctcttgaaggccgcatgatcgtgagcgagtcactgaacctccctaagcctcggccttctcacttgtgaaaaggagatgatgagcttttcagggacacttttttgtaaaacgtttacctgacatataggaaaggctctgtagatggtaggtatcattgtggtcactgccagtggcagcttcggagggaggaggccgctgccggatatcaggcagccatcactgtgaagctggggttctgtggcctccatcctctcccctcgacctccccaagacctggcaaagctcagcccctgagaaggccctctctgttggcccag

SEQ ID NO: 296526 - DNA, 672 bp, Homo sapiens
gtcgagcgccaccgcggtgttggcgagtgtgaagagagaggaggagcgtttgcggcctcagcgtctgtcaacagaaccctcttcacccgtggttaaaccctccctaaccctgagctcgtgctcccctcccggtggacgcagacctgaccacagaagccctgcagcactcactgggggcttgagggagcccctgagtcccctccaccctcgccgccttctcctgggtacccaggaaacgtctccaagggaggctgtgacccaggaccccgcctcgacctcaccttcttctgtaaggcgcagtgaaagacgaagatgaagaccccctggaaggcgttgaaggtggtgaagagataggccatgaccaccgactccttgttgatgaagaggaggccgaaagcccaggaagagcagctcagccaggaagaggttgatgcacaggttcttgtggatggtgttgcggtcggtctgcagcccccgcaggaagcagaaggtggagatgcagatggccaagcagaccagggagatcacaatgcccacccagtgagagcctcgaagatgtaatcacagagagagagagagagagagcgagagagagacagagagaggagcatcggctcaccaagaaggcctgtcctggtcccaggggccacagcgggatggcccctaccaacc

SEQ ID NO: 296527 - DNA, 465 bp, Homo sapiens
gggcattgggaaagaaacacatagacggggtggcgggggtgggggtgcatgctccagggtcatggtgtcatagacacccccaaattgggaaggggcagtggagctggaaaccaagtgatatagtttggatctgtgtccatacccaaatctcatgttgaattgtgatctccagtgttggaggtggggcctggtgggaggtgattggatcatgggggcagtttctaatgaatggtttatcaccatcccctccgtgctgttgagatctggttgtttaaaagtgtgtagcacctcccctgttctcttttcctcctactccagccatgtacggcgtgcctgcttccccttcaccttctgctgtgattgtaagtttcctgaggcctccccagaagcagaagctactatgcttcctgtacagcctgcagaactatgagccaattaaatgtcttttctttataaactacccaa

SEQ ID NO: 296528 - DNA, 549 bp, Homo sapiens
gtcgagcgccaccgcggtgttggcgagtgtgaagagagaggaggagcgtttgcggcctcagcgtctgtcaacagaaccctcttcacccgtggttaaaccctccctaaccctgagctcgtgctcccctcccggtggacgcagacctgaccacagaagccctgcagcactcactgggggcttgagggagcccctgagtcccctccaccctcgccgccttctcctgggtacccaggaaacgtctccaagggaggctgtgacccaggaccccgcctcgacctcaccttcttctgtaaggcgcagtgaaagacgaagatgaagaccccctggaaggcgttgaaggtggtgaagagataggccatgaccaccgactccttgttgatgaagaggaggccgaaagcccagccatgtacggcgtgcctgcttccccttcaccttctgctgtgattgtaagtttcctgaggcctccccagaagcagaagctactatgcttcctgtacagcctgcagaactatgagccaattaaatgtcttttctttataaactacccaa

SEQ ID NO: 296529 - DNA, 3493 bp, Homo sapiens
  misc_feature (11)..(11): n is a, c, g, or t
cctggtacgcnccggaagttatgggatcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaggaaacttgttcctttgagtaagaaggtggagcgtagggagaaaagaagagaggaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcggagaaaacgagcctatgtggaaatagaatacgagcaggagacagagcccgtggccaaagccaaaaccacgtgatttccctttcagcatttatacccaggactgaacatgcagaactgtttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaagaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaacttta

SEQ ID NO: 296530 - DNA, 3586 bp, Homo sapiens
  misc_feature (11)..(11): n is a, c, g, or t
cctggtacgcnccggaagttatgggatcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaggaaacttgttcctttgagtaagaaggtggagcgtagggagaaaagaagagaggaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcggagaaaacgagcctatgtggaaatagaatacgagcaggagacagagcccgtggccaaagccaaaaccacgtgatttccctttcagcatttatacccaggactgaacatgcagaactgtttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaagaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaactttaatgaaaggtggaaaataatttaacttataatgtgaaaatacaatgtgaaatgtacaataaatcatatttatggacagaaaaatgactgggaga

SEQ ID NO: 296531 - DNA, 3489 bp, Homo sapiens
accggaagttgcacgctgagccgcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaggaaacttgttcctttgagtaagaaggtggagcgtagggagaaaagaagagaggaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcggagaaaacgagcctatgtggaaatagaatacgagcaggagacagagcccgtggccaaagccaaaaccacgtgatttccctttcagcatttatacccaggactgaacatgcagaactgtttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaagaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaacttta

SEQ ID NO: 296532 - DNA, 3041 bp, Homo sapiens
  misc_feature (14)..(14): n is a, c, g, or t
  misc_feature (19)..(20): n is a, c, g, or t
  misc_feature (22)..(22): n is a, c, g, or t
atcgctagtagagncgggnntnaatcggccgaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcggagaaaacgagcctatgtggaaatagaatacgagcaggagacagagcccgtggccaaagccaaaaccacgtgatttccctttcagcatttatacccaggactgaacatgcagaactgtttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaagaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaacttta

SEQ ID NO: 296533 - DNA, 2878 bp, Homo sapiens
  misc_feature (4)..(4): n is a, c, g, or t
  misc_feature (68)..(68): n is a, c, g, or t
  misc_feature (75)..(75): n is a, c, g, or t
  misc_feature (84)..(84): n is a, c, g, or t
  misc_feature (89)..(89): n is a, c, g, or t
  misc_feature (102)..(102): n is a, c, g, or t
  misc_feature (116)..(117): n is a, c, g, or t
  misc_feature (131)..(132): n is a, c, g, or t
  misc_feature (157)..(157): n is a, c, g, or t
  misc_feature (219)..(219): n is a, c, g, or t
  misc_feature (224)..(226): n is a, c, g, or t
  misc_feature (236)..(237): n is a, c, g, or t
  misc_feature (241)..(241): n is a, c, g, or t
  misc_feature (247)..(247): n is a, c, g, or t
  misc_feature (249)..(249): n is a, c, g, or t
  misc_feature (262)..(262): n is a, c, g, or t
  misc_feature (273)..(274): n is a, c, g, or t
  misc_feature (287)..(287): n is a, c, g, or t
  misc_feature (290)..(290): n is a, c, g, or t
  misc_feature (309)..(309): n is a, c, g, or t
  misc_feature (315)..(315): n is a, c, g, or t
  misc_feature (326)..(326): n is a, c, g, or t
  misc_feature (351)..(351): n is a, c, g, or t
  misc_feature (357)..(357): n is a, c, g, or t
  misc_feature (362)..(362): n is a, c, g, or t
  misc_feature (371)..(371): n is a, c, g, or t
ctcncacacgcacgcgtcactgtctgcaccaaaaacatcagcagcattttcagcatcaacagcgctcnaaaaaanaatttgtcnaagangggaaggtatatnagacgaacaaaatnnagtggcacaagagnnataaactggattcccatcattgatnaatatcactataaaaataaccaccaataaaaaataataataaaactcccggacgcctaaacncaaannnaaaattcccnnaaangcaccncntcgaaaaaaatcnatcctatttgnnaaatagaataacnatncatgaaaaagacaaagggnaaaaanaaaaaaaaaanaaaaaaaaaaaaaataaggaataanaaccanggaanatgaagaantttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaagaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaacttta

SEQ ID NO: 296534 - DNA, 1330 bp, Homo sapiens
cggacgcgtgggtcgacccacgcgtccgagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaactttaatgaaaggtggaaaataatttaacttataatgtgaaaatacaatgtgaaatgtacaataaatcatatttatggacagaaaaatgactgggaga

SEQ ID NO: 296535 - DNA, 1099 bp, Homo sapiens
cgacccacgcgtccgcggacgcgtgatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaactttaatgaaaggtggaaaataatttaacttataatgtgaaaatacaatgtgaaatgtacaataaatcatatttatggacagaaaaatgactgggaga

SEQ ID NO: 296536 - DNA, 531 bp, Homo sapiens
tcagatactgaggaaaaagatgatgatgatgatgatgaggaagtaagtcttgtttttgttttgccaaacctactagataccatttgtataaaactgagaaacagaatatcatcttcagtctgctaaccaaaaatgatatgtcttcttttttctttcatgtgattaattttggtttagcactggttgctctgttcttcaggctaaccaacaaaccattaacaattttagtcttaatttattggtcttctaaaattgttcctgcaaggtgacaaattataaagcctttcctgtctatatgtagtttttaaccataatgaggatgttttattgctaataatttaaatcaagaataagaatgatctggtagccctaaaatttttaaaattcagaagcattaaatttagaaagaactaaattttcattgcctagtgaaaagactgtggttctcattatgttattttgtacttacttagatgtctaatctgaatcttcattatgtattctgaacctaacagttatgttttatttata

SEQ ID NO: 296537 - DNA, 1336 bp, Homo sapiens
agcggcggcggggaaggaggggtgcttcaggtgcctgcgacctccgcgcctcccgcccggaagtgcccgaggggccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 296538 - DNA, 1676 bp, Homo sapiens
aggctctacccccacctcttagaaactttagcagcggagtagatgagcctggggtgaagtcggtgaaggagtagacacactggggtgaagtgggcaggagaatagatacgcttgggggtgaagtttggttggggtgaagtttaggagaggcgttgcttaggcccttaccttgggatagggtttgggtgagttgggagctggttgaagacctcgagctcagatgacagaaagttaggacttgggattcggcgatgggaaggggcacccggaggcaagtttggggcgactgggaggcagagaagccggtaccctggggtgggtgaggggacggaggctgaggacggtgggagcgtcgcggtggggtgagggcaggaccctgtggaggttccagggctcctggccagggggcccgggcctcacgggctctttgtgcctctccagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 296539 - DNA, 1294 bp, Homo sapiens
  misc_feature (21)..(21): n is a, c, g, or t
taatatcggtctaggtacgangctgggtggtgccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 296540 - DNA, 1506 bp, Homo sapiens
aggctctacccccacctcttagaaactttagcagcggagtagatgagcctggggtgaagtcggtgaaggagtagacacactggggtgaagtgggcaggagaatagatacgcttgggggtgaagtttggttggggtgaagtttaggagaggcgttgcttaggcccttaccttgggatagggtttgggtgagttgggagctggttgaagacctcgagctcagatgacagaaagttaggacttgggattcggcgatgggaaggggcacccggagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 296541 - DNA, 1630 bp, Homo sapiens
agcggcggcggggaaggaggggtgcttcaggtgcctgcgacctccgcgcctcccgcccggaagtgcccgaggggccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcaaaaaaaaaaaaaaaaaaaaacaacaaatttggtgggcacacactggaacagaagaaaccttttttaaacaacatggttggggaacagggagcaacaaaggaaaaggaaaacgggccaacagggcccaagcagaaaaaccggggcagcacacaaaggacgaggagaaacacaaaaataaaaaaaagcgccgggggagaaacaaacagtcaggcacaaaaaccacaaggagcgaagagagacgaaaagcggaactacaacacagagatgacgagaaaaccaacaataaacaagccg

SEQ ID NO: 296542 - DNA, 1299 bp, Homo sapiens
gctactaaaattggaacgatacagagaagattagcatggacccctgacgcaaggatgacacgcaaattcgtgaagcgttccatatttttgcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 296543 - DNA, 964 bp, Homo sapiens
  misc_feature (21)..(21): n is a, c, g, or t
taatatcggtctaggtacgangctgggtggtgccgcgatggagctgggggagccgggcggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 296544 - DNA, 709 bp, Homo sapiens
aggctctacccccacctcttagaaactttagcagcggagtagatgagcctggggtgaagtcggtgaaggagtagacacactggggtgaagtgggcaggagaatagatacgcttgggggtgaagtttggttggggtgaagtttaggagaggcgttgcttaggcccttaccttgggatagggtttgggtgagttgggagctggttgaagacctcgagctcagatgacagaaagttaggacttgggattcggcgatgggaaggggcacccggaggcaagtttggggcgactgggaggcagagaagccggtaccctggggtgggtgaggggacggaggctgaggacggtgggagcgtcgcggtggggtgagggcaggaccctgtggaggttccagggctcctggccagggggcccgggcctcacgggctctttgtgcctctccagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagagaggagttccccggaacccgtgcagattaaagtaactgtgaagttttca

SEQ ID NO: 296545 - DNA, 814 bp, Homo sapiens
agaattactccttaagtgacccttttgggtgaacaccttcagtgcacctaaagtgccgtatgcacaacaccactttctttcttctgtttctttcctcctttcttctttctttctcttctcttttaattaaataattttcacataagccagtgtggatttatctgtaacaatccaatatttttgacctattatagctggctagcatctatttctttctttaatcactattaatttccttttaagttatggtcctgggtgccttggttaaacctattggcatttacaagagatgttgggtgtcaaagtaaacattgtatattaataagcctgttagcatttgaactgctctcttttccccttcgtagtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatc

SEQ ID NO: 296546 - DNA, 1469 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatc

SEQ ID NO: 296547 - DNA, 956 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggtgagtgcgtacctgctcgcccctgccgcgccgcgccgccttgctggggcctggaggtgtttccagagggtttctgtgctggagcccgggacttggttgcgccctgaaagccttgcctggactcttgccaccctcacagagctgataggtggcctgccgaggaggacgtgtactcatggtggcgtggtgctctagcgccccggaataatcctgaaaatgggaacgctgcctccaagagaccgcgcagcctggagaagtcgccagggacaggatcaggacttgatcctcgcggatcgatatggtctcattcctctagcgttggggtgatgacctactgcccgcctgctgcctgttactgtaaggcctgctaagaattttttttttttttactttttttaatgactgaaaagaaataaaaagaaatataatactttgtgacacgtgaaaattacatgaaattacgattt

SEQ ID NO: 296548 - DNA, 817 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccagagctgataggtggcctgccgaggaggacgtgtactcatggtggcgtggtgctctagcgccccggaataatcctgaaaatgggaacgctgcctccaagagaccgcgcagcctggagaagtcgccagggacaggatcaggacttgatcctcgcggatcgatatggtctcattcctctagcgttggggtgatgacctactgcccgcctgctgcctgttactgtaaggcctgctaagaattttttttttttttactttttttaatgactgaaaagaaataaaaagaaatataatactttgtgacacgtgaaaattacatgaaattacgattt

SEQ ID NO: 296549 - DNA, 732 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagatatggatttttgcagtacgatgtgcttgaagcacttaacatggaatccagaccagggtgctgagg

SEQ ID NO: 296550 - DNA, 1755 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggttcacagatgccctgacttatgttcacagacatgagccccaggttaaaacacgctttcaataaatgactgaatcgagaagtgcctccctcccgtgtgatctcctcgatgctgcaaaactagatctaaagaggagtaactcagtgccccttctcctggacttcacagtccggtcagaagagacaaataactggcctgttgtgataagctacagcagacctcccagctggcccccaggtggagagagatggggaaaaggaggcatcgcagaggaaatgtgatttcatgtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatc

SEQ ID NO: 296551 - DNA, 1726 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggacatgagccccaggttaaaacacgctttcaataaatgactgaatcgagaagtgcctccctcccgtgtgatctcctcgatgctgcaaaactagatctaaagaggagtaactcagtgccccttctcctggacttcacagtccggtcagaagagacaaataactggcctgttgtgataagctacagcagacctcccagctggcccccaggtggagagagatggggaaaaggaggcatcgcagaggaaatgtgatttcatgtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatc

SEQ ID NO: 296552 - DNA, 2818 bp, Homo sapiens
  misc_feature (1212)..(1212): n is a, c, g, or t
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagtaagcatctccaccctaatattgtctctgagtgaatggggggataaaaacccttgtgaactaagtatgctgttattttaggccccttgacactatatggaatagaagctatttcctgactattccatatgaagaatgtaaaaggaggaggaggtaagttttgaaccatctttgtgagttgtaattcaaaacaaaaaatgtagaagaaaaatgaggacagcaacattattgagcaatgcgtatacgtcatttttcagagacaggaagccttaactcttttacaaaaggagcaaaactcttttccataaatggtcatccgcatggagtaatgcaaattactttctaagaaaagggccttatatcaagctttnggctcatttctcctaaatcctcaaacaaagcaagcccatggtgattaggattttaatgtaagtgagcctgttctgccacagctacaaagaacaccaattagttcaaagcttaatccaacatagtggtctctccattgttatttacactatttgtctcttagttctcttataaagcactagaaggaaaaagaataattaagaatgatagtcagtggattacaaagttaattttaatatcaaagaactaaatccatgttactgtcgttctaactgccattgagttaaaacatgtagtacatgtagtcctaatcctgtttagattcagcctctgagtgatttccccattatcctgaccattcatattttactttatcaattgtgtgtttctgtcaacataaagtttcctacgtgttttgatagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatagtctgtcggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgtgtgtgtgtgtgtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaacc

SEQ ID NO: 296553 - DNA, 2794 bp, Homo sapiens
  misc_feature (1212)..(1212): n is a, c, g, or t
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagtaagcatctccaccctaatattgtctctgagtgaatggggggataaaaacccttgtgaactaagtatgctgttattttaggccccttgacactatatggaatagaagctatttcctgactattccatatgaagaatgtaaaaggaggaggaggtaagttttgaaccatctttgtgagttgtaattcaaaacaaaaaatgtagaagaaaaatgaggacagcaacattattgagcaatgcgtatacgtcatttttcagagacaggaagccttaactcttttacaaaaggagcaaaactcttttccataaatggtcatccgcatggagtaatgcaaattactttctaagaaaagggccttatatcaagctttnggctcatttctcctaaatcctcaaacaaagcaagcccatggtgattaggattttaatgtaagtgagcctgttctgccacagctacaaagaacaccaattagttcaaagcttaatccaacatagtggtctctccattgttatttacactatttgtctcttagttctcttataaagcactagaaggaaaaagaataattaagaatgatagtcagtggattacaaagttaattttaatatcaaagaactaaatccatgttactgtcgttctaactgccattgagttaaaacatgtagtacatgtagtcctaatcctgtttagattcagcctctgagtgatttccccattatcctgaccattcatattttactttatcaattgtgtgtttctgtcaacataaagtttcctacgtgttttgatagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatagtctgtcggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaacc

SEQ ID NO: 296554 - DNA, 2385 bp, Homo sapiens
ggccgccggagcagtccagagcgcgcgccgggccgacgaggaagtggaccccgcctagccgagcgctaattggctcccgggctggcagcttcgccgcagcaggagcgcgggcggcgcgcacggcggcggaaccagccggagccgagcgagggcgaagcgggcgtgcgccagtgcagtgccgcgggccgcgcgcgctcccgatagggaagggccggagctgcgcaggggcgcgcggaagaggccaagctagccggagccccgccccgccccgccccgccccaacgggggctggaacccggcgccgagagtagagaaaaggggcctctggtgaccgcccctacctggcatccctctaacccaggaggagcgtggggaaaggggctgtgggcctctcggggagcgagctgcgggtagcggcgcactgggtacaggcgcgcgcttggctgtcgcctctgccgctgtgtttgggaggactcgaactggcgccaggaaatattaggaagctgtgattttcaaagctaattatgaaaacatttatcattggaatcagtggttcacagatgccctgacttatgttcacagacatgagccccaggttaaaacacgctttcaataaatgactgaatcgagaagtgcctccctcccgtgtgatctcctcgatgctgcaaaactagatctaaagaggagtaactcagtgccccttctcctggacttcacagtccggtcagaagagacaaataactggcctgttgtgataagctacagcagacctcccagctggcccccaggtggagagagatggggaaaaggaggcatcgcagaggaaatgtgatttcatgtgtgacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatagtctgtcggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgtgtgtgtgtgtgtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaacc

SEQ ID NO: 296555 - DNA, 1444 bp, Homo sapiens
agaattactccttaagtgacccttttgggtgaacaccttcagtgcacctaaagtgccgtatgcacaacaccactttctttcttctgtttctttcctcctttcttctttctttctcttctcttttaattaaataattttcacataagccagtgtggatttatctgtaacaatccaatatttttgacctattatagctggctagcatctatttctttctttaatcactattaatttccttttaagttatggtcctgggtgccttggttaaacctattggcatttacaagagatgttgggtgtcaaagtaaacattgtatattaataagcctgttagcatttgaactgctctcttttccccttcgtagtgtacctggatggaacaaaatctgaagaggacctctttttgcaagtatatgaagatctaatacaagaactagcaaagcaaaagtgtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatccaatagtctgtcggaattcattgtgtatgtttatgtatttgtgtgtaggtgtgtatgtgtgtgtgtgatacatacatacatcaagtatcacaagacattgaccttatatattatgcactgtgatgtttttccgtctttaattataaaaaacatattgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagtgtgtgtgtgtgtgtgtgtgtgtgtgtgtgtgtgtgttggcgtgtatctaataccattgtatctcattgttgagactttgttacaaatagggtttctggtttctttctcccccctcgtggttcattttgtttttgtcaaaccagtggtctaaaatcacagaaataagcaattacttcaatcatgtggaatccaggggacctatctttggaaagcacagaaggagatctgaattgtgtgatctcttgaggctgctttcaatgctggaatttaaattatgtactgaacaatcttttgcttattaataaaaagattacacacaacc

SEQ ID NO: 296556 - DNA, 778 bp, Homo sapiens
tgccaaatcaagtattccactgggcttccttcgtttaagaaaagggattaaagtaacaatactttccccacatcaaggataacactccaaaacaaggattatactgcagacaactaccctttgtggttttattctagtcttcaaactatatcattctctgaagtcaaggattactatacgaactacaagtgatattggatatctatctgatattttaaggtatgcttcaaatttaatgcagggattaaaagaatgggacttggactcaatttagttctttacaggaaaccagcatttttggctccagaatccctctaatttaaacatccttagatttactgttgttgatgtaaagatttaataaaatgagaattggaattctccattaatttctttttatgtttattcccaaggtttgcaagtgacagcataaagacggaacacaacaaatccttcctgaagtgaattaggaaactccaaggagtaatttaagaaccttcaccaagatacaatgtatactgtggtacaatgacagccattgtttcatatgtttgatttttattgcacatggttttcccaacatgtggaacaataaatatccatgccaatggacaggactgtaccttagcaagttgctccctctccagggagcgcatagatacagcagagctcacagtgagtcagaaagtctccactttctgaacatagctctataacaatgattgtcaaacttttctaactggagctcagagtaagaaataaagattacatcacaatc

SEQ ID NO: 296557 - DNA, 3542 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttca

SEQ ID NO: 296558 - DNA, 3488 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaatagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttca

SEQ ID NO: 296559 - DNA, 3394 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtcca

SEQ ID NO: 296560 - DNA, 1349 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggtgagtggaaataccatacaaacagcctaacctccacattcagtagttctcctttcttcttcttcacaagctcaaatagtcattttttgtgtaaatacagtcacacatcacttaatgacagggatatattctggaaatgcatcctttggtgatttccttgctgagctgccatcatagagtatgtttacacaagctcagatggtataaactactactacacacctaggctatatggctgtaaacttgtacagcatgttaccatactgaatactgtaggcaactataacacaatggtgagtatttatgtatctaaatatat

SEQ ID NO: 296561 - DNA, 4072 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaaggaagtgcattttcagctgagcacctcaaacttcaactccagaaggaatccctaaatgagctgaggaaggagtgcactgcaaaaagagaactcttcttgaagactaatgctcagttgacaattcgttgcaggcagttactctctgagctttcctacatttaccctattgatttgaatgaacataaggattactttgtatgcggtgtcaagttgcctaattctgaggacttccaagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtttccactgtatccaaaaggaggggagaagttgcagtttgattatggtgtctatcttctgaacaaaaatatagcacagctaagatatcaacatggactagggactccagacttgcggcaaacccttcccaacctgaaaaacttcatggagcatggactaatggtcaggtgtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttcacccgacctgatttttttttaccagcttggaaattcctcttgaacctacgtctccatatgtcacatcatgacaggactagcctgaacaaaagccatgtctatctaagcggaggctgttgacttcattcagtttgcatattgtatatagcaacacaaacacttgacaggtatatactccagtcgccacatttgtcctgcataacagcttcactcacaggcctcaccgtcactttattttgtgtccaagcattcctgggctcaagtttaatgtatagctacattgttgttttccatgtagagaactcacaggatgactacatcacaaataaacccaactctcaggcagtcgaaagctttaactggatctgcagaagcccatcttcctccacatgaagaagtggggctccttcacctagagcaggagcttctctgcagtgtactgtctgtcgctcattttggagtcagtgtgggtggagacagcatcgtggatatgcacgtgctgcggggccctccagggaagtaacatttacc

SEQ ID NO: 296562 - DNA, 1381 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacggcttcatagagcccagtgtgcaattaaacagactcaggtaactgttcagaaaattggaaaggaaattgaagaaaaactaagactcacatctacaagcaatgaactgaaaaaaaaaagtgaatgcctgcagttaaaaattttggtgcttcagaatgaactggaacggcagaagaaagctttgggacgggaggtggcattactgcataagcaacaaattgcattacaagacaaagcaagcatcaattatcttcatatttacgttggttctccttgcctcctaagtcctgtgaggagcatttcaggttaatcctgtgaatgcagtggtttgtggtaaagctgaagaacctcaggctcaggaaacctgaatctttcttaatagattggaagtaaacctctctgatgcttgtcccagaggaaaattattatcatgatgtttgatcgttggacaaaactgccctctgctgtggagggagacaccatctctgtcttacaacaaaagtcagtgtctgtgcttgtaacacaaacagaaatgagaaacctatttagaattatctcccaataataaattcattattttgattgtg

SEQ ID NO: 296563 - DNA, 1446 bp, Homo sapiens
cactgcggtaatatggctcttccttagccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcagcggcgtcttcgacatcttcggaacattgctgcccggaacattgttaatagaaatggccatcagctccttgatacctactttacacttcacttgtgtagtactgaaaagatatataaagaattttatagaagtgaagtgattaagaattccttgaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcagattcatgcccgaaaccaaaatgaaataatttttgggctgaatgatggatactatggtgctccatttgaacataagggttattcaaatgctcagaagactattcttctgcaggtggatcagaactgtgttcgcaattcttacgatgtcttctctttgctacgaaatatcctgcttttgccagtttaataagtggaagtatggtggaaaataaagggctttggtccttcacctaaattccagtcctaaaactgccatgtgtaggtagactggatgcaagactttgagcaagtaacgtcaactttttgtataccttagtctgcttttgtaaaatggggctaatatttgtctcttctattaggaatattgttagaattaaataagataaaatatttgaaagatcttaggatagttactggcatatagtagacatttaataaatgttagttttcttcttcctctttacttacctggtcttggatatagctttctcctctaagccagtattccttttccttgttaccactagcttttctacttttcagcatattttccctttctctccccagcattctagtgttttccatatctgcttttataactgcatgatggattcttcttgctcactgcccagaaaagtcaatgcattgagaacaggttttgcagcaaagaaagagtttaattattacagggccagccaaatggaaggatgggagataattctcagatccgcttcctcagaattcacaggctagagtgtttcaaggatagtttggtaggcagaggtctaggaaatggggaaacctgattagt

SEQ ID NO: 296564 - DNA, 3515 bp, Homo sapiens
ccacaaagcagtggaaatcgagcaggagcgggtgaagtcagcgggggcctggatcatccacccctacagcgacttccggttttactgggacctgatcatgctgctgctgatggtggggaacctcatcgtcctgcctgtgggcatcaccttcttcaaggaggagaactccccgccttggatcgtcttcaacgtattgtctgatactttcttcctactggatctggtgctcaacttccgaacgggcatcgtggtggaggagggtgctgagatcctgctggcaccgcgggccatccgcacgcgctacctgcgcacctggttcctggttgacctcatctcttctatccctgtggattacatcttcctagtggtggagctggagccacggttggacgctgaggtctacaaaacggcacgggccctacgcatcgttcgcttcaccaagatcctaagcctgctgaggctgctccgcctctcccgcctcatccgctacatacaccagtgggaggagatctttcacatgacctatgacctggccagtgctgtggttcgcatcttcaacctcattgggatgatgctgctgctatgtcactgggatggctgtctgcagttcctggtgcccatgctgcaggacttccctcccgactgctgggtctccatcaaccacatggtgaaccactcgtggggccgccagtattcccatgccctgttcaaggccatgagccacatgctgtgcattggctatgggcagcaggcacctgtaggcatgcccgacgtctggctcaccatgctcagcatgatcgtaggtgccacatgctacgccatgttcatcggccatgccacggcactcatccagtccctggactcttcccggcgtcagtaccaggagaagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggagatcattaacttcacctgtcggggcctggtggcccacatgccgctgtttgcccatgccgaccccagcttcgtcactgcagttctcaccaagctgcgctttgaggtcttccagccgggggatctcgtggtgcgtgagggctccgtggggaggaagatgtacttcatccagcatgggctgctcagtgtgctggcccgcggcgcccgggacacacgcctcaccgatggatcctactttggggagatctgcctgctaactaggggccggcgcacagccagtgttcgggctgacacctactgccgcctttactcactcagcgtggaccatttcaatgctgtgcttgaggagttccccatgatgcgccgggcctttgagactgtggccatggatcggctgctccgcatcggcaagaagaattccatactgcagcggaagcgctccgagccaagtccaggcagcagtggtggcatcatggagcagcacttggtgcaacatgacagagacatggctcggggtgttcggggtcgggccccgagcacaggagctcagcttagtggaaagccagtactgtgggagccactggtacatgcgccccttcaggcagctgctgtgacctccaatgtggccattgccctgactcatcagcggggccctctgcccctctcccctgactctccagccaccctccttgctcgctctgcttggcgctcagcaggctctccagcttccccgctggtgcccgtccgagctggcccatgggcatccacctcccgcctgcccgccccacctgcccgaaccctgcacgccagcctatcccgggcagggcgctcccaggtctccctgctgggtccccctccaggaggaggtggacggcggctaggacctcggggccgcccactctcagcctcccaaccctctctgcctcagcgggcaacaggcgatggctctcctgggcgtaagggatcaggaagtgagcggctgcctccctcagggctcctggccaaacctccaaggacagcccagccccccaggccaccagtgcctgagccagccacaccccggggtctccagctttctgccaacatgtaaaacctttgagtacatccagccttagttcttggggtgcagtagtatgtacccaagggcagatgcctcttggggaaggccatggggacctgaaacattgccccatggaaatgtcgaccctgtgcggacattccgcatactgccatgaagacggtctctgtgtcctcagctcaagaatcctgtagcttgtcccatcataatccattcacccgttcatcatgtgtactgagcagctaccatgttcaaggtaatatgccaggcgctgtatgtctccactgccaagtagaagtgactcaaaaccctctgacaaggatattcccttggctatggtcctgccaggtgcaggcccaggcccatgaccccacctttactaagcacaagtacttgccactgccatcactgccaagtaactagatgtctctgtttccctgccaatgatcctgcaggttctgcccggtctggttatcttcctgttcctgtagcatagccaggcactgccagtcacctgtgcccccattgctgtcagcagatgtcttgggtcctgagtgtgggtatccacttttacccgctcactgccacctgtggacactctgtgtctaccctctgagtgggaacatacttctaagttccctgcagtctctgtcctgtggtagaccatctttttgtaaactgcgagcttcctcttccctgtaccctctgccccagtcgtgaccccctaaaagttaaggggtagttggcacctccttattaatatgccagcctagatcccccccggtggaggggcaaatggctgaatccttgtgtgatatttttttcttcgcttgtttatttattcatttatttaattgtatttattcatttactaactttatgtgttaccaattaattttgtttacccattcctttatccatccctcccctccttttcaggtaaggagacaggaggagtaggaggaggcagggcctctccatgccagcctctgtggtccttgcccaaacccatcagcgcaatacttgaaccttctcccaggtaggggcaggaggagccacatgagagagggagaaggaccgcgtttacctttagagttttgttttgttttttccttctgagtttgctgttggtgcaggaataagggaaaggcccaaggtatccaagcctggggaagggcaggccagccagcacctctgccttctcagggacaagagtagtcctttaccaccctcactctgcctgtcccctctcctactctacagcattaaagactgtgggaccaggaccctaagtctcctttccttctgggtggggagttctggggttcttggtgtgtgggagaagttttataattgcttccaaacagctgggtttaaatataaaatagacacactcattttt

SEQ ID NO: 296565 - DNA, 900 bp, Homo sapiens
aatctagacgatccccttagacggtacccaacacatgaagacggtctctgtgtcctcagctcaagaatcctgtagcttgtcccatcataatccattcacccgttcatcatgtgtactgagcagctaccatgttcaaggtaatatgccaggcgctgtatgtctccactgccaagtagaagtgactcaaaaccctctgacaaggatattcccttggctatggtcctgccaggtgcaggcccaggcccatgaccccacctttactaagcacaagtacttgccactgccatcactgccaagtaactagatgtctctgtttccctgccaatgatcctgcaggttctgcccggtctggttatcttcctgttcctgtagcatagccaggcactgccagtcacctgtgcccccattgctgtcagcagatgtcttgggtcctgagtgtaaggagacaggaggagtaggaggaggcagggcctctccatgccagcctctgtggtccttgcccaaacccatcagcgcaatacttgaaccttctcccaggtaggggcaggaggagccacatgagagagggagaaggaccgcgtttacctttagagttttgttttgttttttccttctgagtttgctgttggtgcaggaataagggaaaggcccaaggtatccaagcctggggaagggcaggccagccagcacctctgccttctcagggacaagagtagtcctttaccaccctcactctgcctgtcccctctcctactctacagcattaaagactgtgggaccaggaccctaagtctcctttccttctgggtggggagttctggggttcttggtgtgtgggagaagttttataattgcttccaaacagctgggtttaaatataaaatagacacactcattttt

SEQ ID NO: 296566 - DNA, 443 bp, Homo sapiens
ctcgtggtgcgtgagggctccgtggggaggaagatgtacttcatccagcatgggctgctcagtgtgctggcccgcggcgcccgggacacacgcctcaccgatggatcctactttgggggtcagcaggcctcagggagggtggcagggtcacgagcagacagtggagagggcaactgctcccaggctctgggtccctgcctcagtacgctgcagaatcacagagctccagcccctccccaggcctactcagtgagaatctctgggctggggtctggagctctatagtttttgtttgtttgtttgtttgtttgttttttgaggtggagtctcgctctgttgcccaggctggagtgcagtggcgcaatctcggctcactgaaagctctgcctcctgggttcacgccattctcctgcctcacactcccgagtagctgggaccacagg

SEQ ID NO: 296567 - DNA, 435 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 296568 - DNA, 700 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatgggtctcactctgttacccaggctggggtgaagtggcccaatcacagctcattgcagcctcaacctgggaggttcaggtgatcctcccctcagcctcctaagtaactgggactacaggtgtgggccaccgtgcctggctaattttttgtgttgttttttagagatggggtttcaccatcttgcccaggctggtctcaacctcttggactcaggcaatcctcctgccttggtctcccaaagtgctgggattaagaggtgtgagccactatgcctggccaagaaatgcttttaagtagggagtgggtatcccacggaagtattgctttctgaaaaatgaaaatggaattgtagcatgctttattcgaataaaactaaacctcaggccattttttttttaatt

SEQ ID NO: 296569 - DNA, 681 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaaaaaaaaaaaaacaaaaaaaacacaacacaaacacaaacaaaaacaagaaaataaaaacaaaagaaaaaaaccaagctgggggccgccgccgccctgcccccccgcagaagcacttctcacacacacacccggcggcggcgcggccgccccacccgtagcacatacgcagcccaccgggaccacggtgggcttccccaacagcaacgcgtggcccggtaaccggggcgggccacccccacaaaaaag

SEQ ID NO: 296570 - DNA, 692 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaattcagttgtgtttcttttttgtgttcctcatttgctcacgtggctttttcccccaaaggatatataccaacaaatcttgtaacataaggttcttatgttcttattactatgtcattctgggaactctggatatctgttgtcaggagaaagcagatactgacctcaaccaatgaaatctccagaaataggtgcatagaagtaaaagaaccctttaccaattcagaatcagtgtggtagccatatcatctcattcaaca

SEQ ID NO: 296571 - DNA, 551 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatgggtctcactctgttacccaggctggggtgaagtggcccaatcacagctcattgcagcctcaacctgggaggttcaggtgatcctcccctcagcctcctaagtaactgggactacaggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 296572 - DNA, 766 bp, Homo sapiens
ggggtttgcaggtcttgtttcttgaatatctgtaaaaataactgctttagccttttttggaggatatttttgagaaatatgtatttctcaaacacacacatatgtattatatatatatacacgcagagagagtttttacttcaaaaacttttaaagagtaaataatatcatgaataatttcactaatgtttttagttaggcaaacctagaattttaaaatgttgattttgaattttatgactgatttggaataattctggcaattagttaattactcatctgaggcattcatttctagtggtcttaattccctgactccatagatctggcatgatgtttgaaatctgactttctaaaataaatatttttctgtaggtggtctgctgtgtgaataaataattcctgaagaatgaagaagattaattttgggagttctttgacgaactttgatatgtggaaaaagtatttataatttattgtaagaagaaagtaaaatattactagtggaattcagttgtgtttcttttttgtgttcctcatttgctcacgtggctttttcccccaaaggatatataccaacaaatcttgtaacataaggttcttatgttcttattactatgtcattctgggaactctggatatctgttgtcaggagaaagcagatactgacctcaaccaatgaaatctccagaaataggtgcatagaagtaaaagaaccctttaccaattcagaatcagtgtggtagccatatcatctcattcaaca

SEQ ID NO: 296573 - DNA, 540 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtggtttcgtggtcgggtctctgttgacttatcccgtagcttagtaccgggaaacgatggagagagaggagaacggcaagcttcaaccactcattccttcctacaaattatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 296574 - DNA, 567 bp, Homo sapiens
ttgagctgttctctgtgcccttcatttagcataaatattttactcagtttatttctttatagagcagtgctactccttggatattgactagaggcaatatttaatatgcgtgattatttcttatcagatttcccccccaaaatcacttatctgtggaatgtcttcataggcatgggcatatcataagatcaaataaaaacaaagctgtttgaggtaatagcgtttgttttaattccagctacattccattatacccgtgttttgtctcactccccatcactatcatgcatacttaataatgtgcttaatgcatatttagataacaagtacattttgttttatagtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 296575 - DNA, 564 bp, Homo sapiens
gtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtggtttcgtggtcgggtctctgttgacttatcccgtagcttagtaccgggaaacgatggagagagaggagaacggcaagcttcaaccactcattccttcctacaaattatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaaaaataaaaaaaggaaaaaaaaagg

SEQ ID NO: 296576 - DNA, 519 bp, Homo sapiens
aaagcttaccgcagtgtcacaatcatagatcctctcatatttttaaaggtaaacaaatgcatttcttatgggagtcatggaataggtaaatgcaagtagaagagaaaaagcagatgtgacagtcaagggcagagagatgacagatactcagatttcatagattagcacagaacttctttcggcctttattaataagattgccctagcggtaaaagcttaagcttttaccgccaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 296577 - DNA, 458 bp, Homo sapiens
gcgaggtgatctagaggatcccagtcgacggagactctctctgcgtgtatatgtattatatatatatacacgcagagagagtttttacttcaaaaacttttaaagagtaaataatatcatgaataatttcactaatgtttttagttaggcaaacctagaattttaaaatgttgattttgaattttatgactgatttggaataattctggcaattagttaattactcatctgaggcattcatttctagtggtcttaattccctgactccatagatctggcatgatgtttgaaatctgactttctaaaataaatatttttctgtaggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 296578 - DNA, 471 bp, Homo sapiens
gcagtgcaatatccatctttcattcctctttttaaaaccctaaaccgctttcctccaactgtatcaaccacagaccttccgtccgattggtagaaagaaagagaaggataaaggcaatgcccagttctgtctgaggtatgggaaaaatggcagcatgggggcactctgaaacagcacaggcacgctaaagaacatggctacagacagcagaaaccttacgttgttggcaggaaatgttcatgttcttggaaccaaccagcttattttcagacataagcagagtggcaatctttcttctgtggaaggcacctggctcactgaagacatctgatgggcacatgttgataaaggagtctacaagcacagcttttcttagaaagtgacatacaaaatgttcaatttatattttgaaaatcaatggaaacaaaaagttgttaaataaaacagcatatacaaattataattttgttt

SEQ ID NO: 296579 - DNA, 1741 bp, Homo sapiens
tgcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagtaaataggaaaa

SEQ ID NO: 296580 - DNA, 2504 bp, Homo sapiens
tgcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactagggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagtaaataggaaaa

SEQ ID NO: 296581 - DNA, 2338 bp, Homo sapiens
tgcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagtaaataggaaaa

SEQ ID NO: 296582 - DNA, 2517 bp, Homo sapiens
tgcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagtaaataggaaaaaaaaaaaaaaaaaaaaaaaaaaaaaaaaaaaaaaaaaaaaaaaaaaaaaaaaaaaaaaaaatatttttgggggggccgaagctttttcccttttggggggggttatttttttttggcccgggcccgctttttaaaaccgggggagtgggaaaacccgtgggttccccaatttaaaatgc

SEQ ID NO: 296583 - DNA, 1748 bp, Homo sapiens
tgcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagtaaataggaaaa

SEQ ID NO: 296584 - DNA, 1897 bp, Homo sapiens
  misc_feature (1870)..(1870): n is a, c, g, or t
  misc_feature (1886)..(1886): n is a, c, g, or t
tgcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactagggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggantaccgccgggggggangtggaggtgtc

SEQ ID NO: 296585 - DNA, 314 bp, Homo sapiens
gtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtgggtaagaaattcaggtgaaaattaagatttacattttgtacctgtacatgctatatggtacaaatggtttttaaaaagtccctgtgttcttggagaaaggaaagtaataactgtgtgttttagtggcaaaatttgaccatggcatcagttagtatgtgactagacaccaatata

SEQ ID NO: 296586 - DNA, 2037 bp, Homo sapiens
  misc_feature (78)..(78): n is a, c, g, or t
atcctaatttctaaagcaatcaggagagaaagcttttagaatggcacatcatatctcattgatgccaacatggttttntccatggttctgactttctgtgaaggcaccagcttgcaatatgccatcccgtttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagctggagaacgctgggcagcaccacaccctccaattcacactgccttctagttgtgccaactggaaccaccctttggctgtgctgcgaaatggaccccagtgttgttgtgggtgtgtcaaatcccctttcatcctcaagagctccctgcttcccttagattatttcaatacggtgatatccttatttgctagcagaaaagggactaacgtccccattcctcttttctgctgcgtcccactggctcagagaagcaaggcggtgcgcggttgggcagaaacctgggaggagtctccaagcccaattcacagcacacaacggcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctgggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatattatc

SEQ ID NO: 296587 - DNA, 1983 bp, Homo sapiens
  misc_feature (78)..(78): n is a, c, g, or t
atcctaatttctaaagcaatcaggagagaaagcttttagaatggcacatcatatctcattgatgccaacatggttttntccatggttctgactttctgtgaaggcaccagcttgcaatatgccatcccgtttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagctggagaacgctgggcagcaccacaccctccaattcacactgccttctagttgtgccaactggaaccaccctttggctgtgctgcgaaatggaccccagtgttgttgtgggtgtgtcaaatcccctttcatcctcaagagctccctgcttcccttagattatttcaatacggtgatatccttatttgctagcagaaaagggactaacgtccccattcctcttttctgctgcgtcccactggctcagagaagcaaggcggtgcgcggttgggcagaaacctgggaggagtctccaagcccaattcacagcacacaacggcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccatttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctgggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaagaaaagcaaggaaaaggctctttattacttaaaagtaataaaacctgactgttctatattatc

SEQ ID NO: 296588 - DNA, 1750 bp, Homo sapiens
tagtcttaggaaacaaaaggtttattgaaatgcatgtagataaattatcatcagcataaaactgttatggagttttcaacatggggtcttttgctcttaaaatgaagtgaagctttgcaagtccattgtccaataggaaaaatattatatctctctgttcagataaagtcctttaaaaaagtaaatctcttttgaaacggtcttttaaacgtctccagcctgtttggctccccccaggtggtgttgctgtccttctccaattgtgagtctgttgaatgggattatcttcatagtggttttcttcatggaataccaccgggttttccaagtggcccaaataatgccattatcataaccattaggagtagatgcttttgagtaagtgccaccttggtaataaactccattgagatggccagcgtgacacttgttcatccaccaaccagatccatcctgttcagcacagttgccttcaaacttatcattgtcattgtcccaggtactgaactgcatgccattatgggatgtgaaaaacttgtcactaggatcatcgccaaaatcaaagccatcaaaggcatctccagcatccccaccagcgaagtaggcatatgttaggcggtacttgtcagcttcaggtcccaccttgaacatggcatagtctgcagtactggttctgccattccagtcttccagttccactcttaatgcatatgggatggcagactgtgtgcttatcaaatgaatcttctcatttcccagccaaaattctgttgtgccagtaggagacagatgtccaaatccttctttatattgaatccagtttttcttgaaatctacactgccatcaagtctcttctgaaacacagtccatccatttccagacccatcgatttcacagtagactaagaattgctggttagctttcagaggtttaataaagtaaagcccgctctgtttagctcccttattggcaatgtcttgacaatctttcccagtgatatcatggatttgcaccgtgtctttgcaaggttcctggcactgtgcttcaagctgggctaccttctctttcaggttaacaatcttttgattatttgaattatatatttcctgcaaatatcgaatacttgagtcatgtgttaaaatcgatgcttcatatttcataatttcttctaacattttcctggacttcaaagtagcagcgtctatcatatttggttttgatgattcatcaggattataagtgagttggattgcttttatcagctgtttgacttctgatgttttgttttcaacttgatgtaagatgtcttccaaagactgtagatccttgtctactttggtttgataagtagacaggaaatctgcaatgccacaggtagttggacaataactaccgaatctttcatctaagatgcagcagttgtctctggtagcaacatatgctacacatgttgaagagagaaataaaagagcatagaagtagagaattaaattccgggggtgcaaggaccaactcatgatgtctgagtgcccggagctccgagccttgtagtgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatca

SEQ ID NO: 296589 - DNA, 1250 bp, Homo sapiens
ggcggggcccggtagccaaaaggctagggggaggcccgcgcagccggtcggcttcggggcgggaccctgcatacctggaagcggcgggtggcgtcctccttgtcgccctcacccacccggtccgggtgtacctgcagggacaccttgtggtagcctcgtcggacctcgccgtcggaggcctcgcgtcgcacgcccagcacccggtaaaggtcggcggtgccgaacacttcctcgcaaaggtccagcagccccatgccgggcggagatacgaccccggaggaagcagccgctcccagctgcgccgggtacaacccaggactgcttctttttcgcgcccaaaaagcccagggcgcctgcgtcacaagcactgaaggggcgtggccacgccgcgcatccgcgctttacggcggccgcaaaatgaggtgtggcgagtcaggcgcgggcccggatccaagatcaaactcagctgaagtcagttcctctcaacctgccctggcatcaaagtctcaaagcaagtgggggccaaccagcaacaaccccaggggagctttgacaaccacagaatttgagatggctggtaatcgttctcagaacataaaacacaaacagacagccctgattgctattccaatgtcatcacaaacccccaggatgcttggaaggccaaggaatcaaggtcagctgtatccacagccctagtctcaagccttcatcctcttacccgatagcaggcgattcccagtcctagccagatagatgagccccagtctcaggaagatgaagtgcatctcagaagcatccactacaaagctaatggttcgttcatagcatgccttggcctcagaatgatttccactcagaaaatagagatggcccttcaggccccagacattggggttctgggaaagtgaaaagcaagtagtatatgggataaggtagtatttaaaagtaccttgatgatctttgtttaacatttaaatttagatagattgtccatttcctttctcttttctttttcagatcaaccgttttctttttctaagagcactcagaaacataaccatttaattgtacaaggagacatttttctagctctgccctcagatttctttcttgcattcttcaaagccattttgggtgtggagtaaatattaagaaaaacattcaagcataaccccaatactgttcacatgagaaaatataagaaatctagaaaaattgaaataaacactatcagctaaagatatcct

SEQ ID NO: 296590 - DNA, 802 bp, Homo sapiens
ggcggggcccggtagccaaaaggctagggggaggcccgcgcagccggtcggcttcggggcgggaccctgcatacctggaagcggcgggtggcgtcctccttgtcgccctcacccacccggtccgggtgtacctgcagggacaccttgtggtagcctcgtcggacctcgccgtcggaggcctcgcgtcgcacgcccagcacccggtaaaggtcggcggtgccgaacacttcctcgcaaaggtccagcagccccatgccgggcggagatacgaccccggaggaagcagccgctcccagctgcgccgggtacaacccaggactgcttctttttcgcgcccaaaaagcccagggcgcctgcgtcacaagcactgaaggggcgtggccacgccgcgcatccgcgctttacggcggccgcaaaatgaggtgtggcgagtcaggcgcgggcccggatccaagatcaaactcagctgaagtcagttcctctcaacctgccctggcatcaaagtctcaaagcaagtgggggccaaccagcaacaaccccaggggagctttgacaaccacagaatttgagatggctggtaatcgttctcagaacataaaacacaaacggtcccatcaggacatctataaaccatggagtttcaggtgcaaggttggaaatccacaggaactcactctcatgtgtgcatcattcagtgatttctccacacacagtgggctgtcagatacatttatagttttttttctttacattgtgcatccttttcttgaggtaaaaatctgatttgcctgttgaaaaaaaa

SEQ ID NO: 296591 - DNA, 515 bp, Homo sapiens
tcggctccaggaggtttctcagctcctctcctcccctagcttctttcctgcggcttgacctgagcctctcgtctacttgctttggcttccacctggaccgaggaatttttcctgccctttatctcacctgcctcgggagaagttgggtcattatccgttgttattttaattttgattaccacagcaataatcgtaattgacaagaggcattacaaggagctgcaacaaaagcaacgactaccaagtgtccagcactcacgaggggccagcaactatgctacgcacctcactggccgtcttttgagaaccctgtctacagatgggaaaactgaggcacactgaagtgaggccacatggctggcgaaagcaggcaccatttcctttgcatctacagctcgggtgcacacaagcttgacatgcgttgtcgctactccttgtggcttcccagggaaggcttttgacccctctccaccccatcacagatgaataaacaggctcagctggcttaaaaaaaa

SEQ ID NO: 296592 - DNA, 458 bp, Homo sapiens
cctcaccttcttctgtaaggcgcagtgaaagacgaagatgaagaccccctggaaggcgttgaaggtggtgaagagataggccatgaccaccgactccttgttgatgaagaggaggccgaaagcccagcaataatcgtaattgacaagaggcattacaaggagctgcaacaaaagcaacgactaccaagtgtccagcactcacgaggggccagcaactatgctacgcacctcactggccgtcttttgagaaccctgtctacagatgggaaaactgaggcacactgaagtgaggccacatggctggcgaaagcaggcaccatttcctttgcatctacagctcgggtgcacacaagcttgacatgcgttgtcgctactccttgtggcttcccagggaaggcttttgacccctctccaccccatcacagatgaataaacaggctcagctggcttaaaaaaaa

SEQ ID NO: 296593 - DNA, 403 bp, Homo sapiens
tggtatgcaggtaagctttcgtcgcagaacaacttcagtatagttgaactttgaagtcgagaatagatatgtagactaggtaaatcacttaggatttttatggtctactttcctatgatgaggtttttaatttaaactttgtgagtgtcaaaatatcacattgtatcagcaacttggtgagcagatcttttagcagattaactgggaacataacccaagaaccaggaaagaatccaaaagaacctgaatagctaaaataaatgttccaaagcatattactgaaagcatgtgcactttatagcctaattttctagcctacaatgggttaaaagcaaaatattaaagggaagaggattgctaggaatagataaacacacagtgatacaattcataaacagcagca

SEQ ID NO: 296594 - DNA, 827 bp, Homo sapiens
tggttgacacaagtgactcaaatatcctaagagtacaaggaacagcctaaaaacagctgttttaagagtcaggaggacttatttctttagagctatttgcaacttctaacaagacacatttggagaaactggttattttaccaaggctttaagtgaaatggcacgcttcctttaaagaatcaaagttgacttataaagccaattaaagcccgttggggaatctgttctcataccttgttcacaaagtccctgtacaaggttcctgacctgtggaaagaaaagctcatatagtaaagaaacatggatctgacgttccacaattctttcagtttcatgtccacttcttccgttaaattattttaaatactttttgtaacatattcaatcttattttatcaacactgtttttgttgcctacctagccctttagtttcatttttatgcaatatctagataatattcagcaaatcttaacaacgattaactctgggtggtaggattttgggtaattagtggcttttatttgaacttctctttgtacaaatgaaaatgttcataatgtgccttcctcatttttagaaaaaaataaagccattattcccctcccaaagttcgaaatatttccttaaaaagtttttcttgaaaatgttaatacattttgaaaaagaactttatttttcaatggagtgattgattacctacatttggtatattatctgcataatacgagttttctttcactaagggggaaaaaaaatccccttctccccagctaaggcagttttcccattggatcccattagaatctttagagccagggagtctgc

SEQ ID NO: 296595 - DNA, 551 bp, Homo sapiens
aggaaacaaaagggaaacagaacagagagttatactcaccttgattatctgaggcacaaatgcagcctcagccatgaacatattgaaggaagggatagtccagtatgtaacagacgcaccctgctattggcaagcaaagcacagatggagtgaatttaaagagtcctttactaaaggactttgtttcaggacgaaagtccacacagagcccacagggtgtgggagatctgagatctggaactgggatctctgggctctgaacttgttctgttgggcaatctgctgatggagaccttgtcttcgagtgtcaggatgcacactgtggtcagctccccctaggttgcaaagggcattctatctgggacttgtcttccctgcccatctgctctccttttcaacagcttcttggttcttttgaaacctatgctgtcttcccaaagccctacctcctattgtgttggcctcctgtaagccatgctttcatctgtccagtcctgctcttggtgggatgaacgagaggcctctacagatctcaaggtggaggaggagag

SEQ ID NO: 296596 - DNA, 2873 bp, Homo sapiens
  misc_feature (236)..(236): n is a, c, g, or t
  misc_feature (419)..(419): n is a, c, g, or t
  misc_feature (438)..(438): n is a, c, g, or t
  misc_feature (441)..(441): n is a, c, g, or t
  misc_feature (725)..(725): n is a, c, g, or t
  misc_feature (802)..(802): n is a, c, g, or t
  misc_feature (845)..(845): n is a, c, g, or t
  misc_feature (999)..(999): n is a, c, g, or t
  misc_feature (1026)..(1026): n is a, c, g, or t
  misc_feature (1032)..(1032): n is a, c, g, or t
  misc_feature (1037)..(1037): n is a, c, g, or t
  misc_feature (1043)..(1044): n is a, c, g, or t
  misc_feature (1047)..(1047): n is a, c, g, or t
  misc_feature (1050)..(1050): n is a, c, g, or t
  misc_feature (1083)..(1083): n is a, c, g, or t
  misc_feature (1106)..(1106): n is a, c, g, or t
  misc_feature (1111)..(1111): n is a, c, g, or t
  misc_feature (1120)..(1120): n is a, c, g, or t
  misc_feature (1653)..(1653): n is a, c, g, or t
  misc_feature (1690)..(1690): n is a, c, g, or t
  misc_feature (2183)..(2183): n is a, c, g, or t
  misc_feature (2222)..(2222): n is a, c, g, or t
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccnttggcttgggcttcctcacctcgagtttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctntgtcggtgctgatctcagnggntgctgtcttggggaaggtcaacttggcgcagttggtggtgatggtgctggtggaggtgacagctttaggcaccctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagagagcaacgatacccagtttgtctgccatgctgggcgccctcttcttgtggatgttctggccaagtntcaactctgctctgctgagaagtccaatcgaaaggaagaatgccgtgttcaacacctactatgctgtagcagtcagngtggtgacagccatctcagggtcatccttggctcacccccaanggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggngtgttgtaaccgagtgctggggattcnccacanctccntcatgnnctncancttcagcttgctgggtctgcttggagagatcanctacattgtgctgctggtgcttnatacngtctggagncggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttgngatgtagtcttactctgtcacccaggctagagtgcantggcaccatcttggctcactgcaacctctacctcctgggttcaagcaaatctcctgtcagcctccaaagtagctgggattacaggcacccaccacatctggctaattttttgtatttttagtaaagatggggtttcaccatgttggccaggctgatctcaaactcctgacctcaagtgatctgcccgcctcggcctcccaaagtgctggaaccacaggcctgagccactgtgcccagccttgtttgcttttttaacagataacagtgtgctcatagaaactgctttgacatgactgcaatcatgtgcttcatagaaacttaattagattataccactagagtcttcagatttttatacttttttttttgaaacggagtctcactctgtcaccaggctggagtgcagtgccgcaatctcggctcactgcaacctccgcctcccaggttcaagcaattctcctgcctcactcccgagtagctggattacaagtgngcactaccacacccagctaatttttgcatttttacttgncagggtttcaccatgttggctaggatagtttcaccaggatctcttggcctcatgatcagcctgcctcggcctcccaaagtgctgggattacaggtgtgagccaccgtgcccagcctatacttccctttttgaataccatttggtgttttgaagaattaacagctttgtgaacgtggcagtgcttgtgattcaggcttccattgagaccaaggggagaacctggttgcaggacaaacagacggacagcgtgtggcagtgtttaaatgctcttctgaaggctgatacgacagctctctgtgcactgattgcatatgcatcccaagattatattattgttttctactgctatgtgtcacactttgccaaacaggatgtggaaaatgaataagcggttttcttaggcacttcttaacagacaattggtcaaaatgaactccattgcttaagaaacacataaacaccatttagtcactgaacatagctatatgtatggttgttactatgggaaatcttgttttgccaattttctttgaaaattctggcagaccaaggttctttttgtttacataatacttgaaaaataaaaatgaacaagctaacaactaccaagttttcacttacataaatgtagttgcatacagaaaatgtgac

SEQ ID NO: 296597 - DNA, 1137 bp, Homo sapiens
  misc_feature (236)..(236): n is a, c, g, or t
  misc_feature (419)..(419): n is a, c, g, or t
  misc_feature (438)..(438): n is a, c, g, or t
  misc_feature (441)..(441): n is a, c, g, or t
  misc_feature (684)..(684): n is a, c, g, or t
  misc_feature (711)..(711): n is a, c, g, or t
  misc_feature (717)..(717): n is a, c, g, or t
  misc_feature (722)..(722): n is a, c, g, or t
  misc_feature (728)..(729): n is a, c, g, or t
  misc_feature (732)..(732): n is a, c, g, or t
  misc_feature (735)..(735): n is a, c, g, or t
  misc_feature (768)..(768): n is a, c, g, or t
  misc_feature (791)..(791): n is a, c, g, or t
  misc_feature (796)..(796): n is a, c, g, or t
  misc_feature (805)..(805): n is a, c, g, or t
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccnttggcttgggcttcctcacctcgagtttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctntgtcggtgctgatctcagnggntgctgtcttggggaaggtcaacttggcgcagttggtggtgatggtgctggtggaggtgacagctttaggcaccctgaggatggtcatcagtaatatcttcaacacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggngtgttgtaaccgagtgctggggattcnccacanctccntcatgnnctncancttcagcttgctgggtctgcttggagagatcanctacattgtgctgctggtgcttnatacngtctggagncggcaatggcatgtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 296598 - DNA, 1079 bp, Homo sapiens
  misc_feature (236)..(236): n is a, c, g, or t
  misc_feature (419)..(419): n is a, c, g, or t
  misc_feature (438)..(438): n is a, c, g, or t
  misc_feature (441)..(441): n is a, c, g, or t
  misc_feature (546)..(546): n is a, c, g, or t
  misc_feature (573)..(573): n is a, c, g, or t
  misc_feature (579)..(579): n is a, c, g, or t
  misc_feature (584)..(584): n is a, c, g, or t
  misc_feature (590)..(591): n is a, c, g, or t
  misc_feature (594)..(594): n is a, c, g, or t
  misc_feature (597)..(597): n is a, c, g, or t
  misc_feature (630)..(630): n is a, c, g, or t
  misc_feature (653)..(653): n is a, c, g, or t
  misc_feature (658)..(658): n is a, c, g, or t
  misc_feature (667)..(667): n is a, c, g, or t
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccnttggcttgggcttcctcacctcgagtttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctntgtcggtgctgatctcagnggntgctgtcttggggaaggtcaacttggcgcagttggtggtgatggtgctggtggaggtgacagctttaggcaccctgaggatggtcatcagtaatatcttcaacgngtgttgtaaccgagtgctggggattcnccacanctccntcatgnnctncancttcagcttgctgggtctgcttggagagatcanctacattgtgctgctggtgcttnatacngtctggagncggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 296599 - DNA, 1004 bp, Homo sapiens
  misc_feature (882)..(882): n is a, c, g, or t
cccgccccgatccaatctctccgcctcactcttcgacatacacaccacgcaatcatgcaaggcaggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtaagatccctcattatggctctccggcaaattatacccaccctcattcccgaaataccccaaacgtctggacacatacacaatcagctctctatcccttcacctgttgcgcttcgttcatgcaccgacagacaacgctctatgaccaccactcgactaacataccacctgctcaacccaccacgcaacctcacccacccccatcaccataacgacgacagactccccagccaaccctcctcacccctagtttgcacccgaccacccctacgtcagacaagccgagccactatacacttccgactccttcgccgccgcgttctcactcccgagcccccgtaaagaccttatcctccccccatctccacacccgatccccaaccatccacatcgctagccctccctccccgtactatacaccactcccttataaaactcgcccattaatttcgccagccactaccacacccagcactccccaccacgatatcctccttccctactgttccgtttcgttcacacttgcccagactccaccccgagccacaacaacgcacaacccgccgacatcagctctcgaccaccatatactgtccatcacccctctaactccgattacacatgcatccctcccgctcatctagtcgaacatacactaactacnctcagccccccgtagtaccaaccgtacctcgtcccgcacgccgtcgttcataaccactaaccacaacctacctagtgcacacctgctaccttctatccacaaccatcaacctccgccccgcg

SEQ ID NO: 296600 - DNA, 340 bp, Homo sapiens
aatattttggagctatgttgctgatttttgttagttcagatttgttatattttctgatatgtgttttaaactgattaatcagtattacacaactttaagctgagactacactcagaaataagtttagaaaatggcattacaaaaggttgggagtgagcagtaaaaaaacaaacaaacccatgcagggctgttgtgctgtgggaaatcagatgtgttcactgccataagtcttcagtgcggccaaacttaaaaaccagccctccaaaaaagatgaaggcattctggaaaaatacagcaattccagggtatactatgtctttttcttttgtgtaaaatgatt

SEQ ID NO: 296601 - DNA, 696 bp, Homo sapiens
acaaacaaaaacagaaaaaaaaaaaaaaaaaagagagagagagaaaactggaggctctgagaggttgagggacttgcccagggtcttgcagctagtaagtgacagagctgggacttgagcttgggttttctgactcctggtctggttcattatccatgaggtgctgggaactaaaataagccacaatcttggaatctccgtcgcctccctccctcccacatgtctgcgtggctttttgggaaaatgccaggggaatgtaccagccagggagaggacccttgttttcctcatggcccttcctggcaatggcactactgacaccgacagtcctttttgtccctgatgacctctgctgcctgatgcccaagtgaccacctctgctttgtcatttctaggattggcttccaggtcctcctcagcattggggaactcagcttggccatcgtgatagctctcacgtctggtctcctgacaggtcagtgtgaggccacctttcttccaccattgccaggacacagcacccacgtccagagcgcaccctgccgtgtggctggatgtctatgtgccccatctccttccctgaggatcacataatttcagaattggaaaggttcttagaggtcacctgctgctaatgtggactgtgaggccagggcagggaagggacatccctgaggttataagtagggtgagtgg

SEQ ID NO: 296602 - DNA, 591 bp, Homo sapiens
  misc_feature (416)..(416): n is a, c, g, or t
ggcgtgtgcggcggtgcggcccgggctccacgtccacaggctgggcagcgctgtgggccccgcgggcgccgagtccgcaggacccgcgagggcactaccgcgaagcatcggcctccgggccgggccgggccggaccgggagcctgctcggcgggtccgggctcctgcaaggcggggacgcggggccggcgacccttcacgcttcgtactcattgagcgccgattttatgccaggcaccgtgctggatctcccagtgcctggaagagaaaacccattctgtttcgaagggcatccagagctggtcacagtggggacccaccctccttttccaggctacgccaggggctgggaagtctgcatgctgtctataaatccagaaccagaagttggccaagatctgaccgtgatggcggccnttggcttgggcttcctcacctcgagtttccggagacacagctggagcagtgtggccttcaacctcttcatgctggcgcttggtgtgcagtgggcaatcctgctggacggcttcctgagccagttccctcctgggaaggtggtcatcacactgttcaggtattgggatggtggctg

SEQ ID NO: 296603 - DNA, 545 bp, Homo sapiens
tgagacagagtcttgctctgtcgcccaggctggatgagactcttgtctctaaaaaagaaacaaagcttgctaactagctagataacatatgttctgcttttgagatttttggaagccaaagaaaagcagtgtttagagctgtctcatcccttccaggctctggataagaagaaaaatgactgaagaaaggaatactaaaaatatataagacaaagaaaaccaaacactgtcggtggagggtggggggtcccggatataaatgcatcgctagtagttggcccaactataggaaaaaaattttattctaaaataaccaactttaatgcaaaattccagtattccactgaagtaaattgtaacctatgttttctcttacctttagcaacataacctccaaaaagaatccacatagatgcaatcagagatccaaaggccaacatgaaaccaacgaaaagccaaatgcgagcaccttcaaagaaataatattttaccagaattctttcttatagggcagtacaattaactttcaaaaagaaaataaaacc

SEQ ID NO: 296604 - DNA, 2100 bp, Homo sapiens
  misc_feature (236)..(236): n is a, c, g, or t
  misc_feature (419)..(419): n is a, c, g, or t
  misc_feature (438)..(438): n is a, c, g, or t
  misc_feature (441)..(441): n is a, c, g, or t
  misc_feature (725)..(725): n is a, c, g, or t
  misc_feature (802)..(802): n is a, c, g, or t
  misc_feature (845)..(845): n is a, c, g, or t
  misc_feature (999)..(999): n is a, c, g, or t
  misc_feature (1026)..(1026): n is a, c, g, or t
  misc_feature (1032)..(1032): n is a, c, g, or t
  misc_feature (1037)..(1037): n is a, c, g, or t
  misc_feature (1043)..(1044): n is a, c, g, or t
  misc_feature (1047)..(1047): n is a, c, g, or t
  misc_feature (1050)..(1050): n is a, c, g, or t
  misc_feature (1083)..(1083): n is a, c, g, or t
  misc_feature (1106)..(1106): n is a, c, g, or t
  misc_feature (1111)..(1111): n is a, c, g, or t
  misc_feature (1120)..(1120): n is a, c, g, or t
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccnttggcttgggcttcctcacctcgagtttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctntgtcggtgctgatctcagnggntgctgtcttggggaaggtcaacttggcgcagttggtggtgatggtgctggtggaggtgacagctttaggcaccctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagagagcaacgatacccagtttgtctgccatgctgggcgccctcttcttgtggatgttctggccaagtntcaactctgctctgctgagaagtccaatcgaaaggaagaatgccgtgttcaacacctactatgctgtagcagtcagngtggtgacagccatctcagggtcatccttggctcacccccaanggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggngtgttgtaaccgagtgctggggattcnccacanctccntcatgnnctncancttcagcttgctgggtctgcttggagagatcanctacattgtgctgctggtgcttnatacngtctggagncggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttaatttttttttttcttttgtaatttctttttatttttacaaattataccatgataaaatttgacaaaaattattcatgtgaaagtttcctctaacattttataagttaatcaagtgcataccacaatagatttttggttgttgtttaggtgttctcgtgattttagtattacacaactttaagctgagactacactcagaaataagtttagaaaatggcattacaaaaggttgggagtgagcagtaaaaaaacaaacaaacccatgcagggctgttgtgctgtgggaaatcagatgtgttcactgccataagtcttcagtgcggccaaacttaaaaaccagccctcccaaaaaaggatggaagggcattctgggggaaaaatacagcaattccagggggggtatacctatggtcctttttttcctttaggggccacccattacccctcc

SEQ ID NO: 296605 - DNA, 1397 bp, Homo sapiens
  misc_feature (236)..(236): n is a, c, g, or t
  misc_feature (419)..(419): n is a, c, g, or t
  misc_feature (438)..(438): n is a, c, g, or t
  misc_feature (441)..(441): n is a, c, g, or t
  misc_feature (725)..(725): n is a, c, g, or t
  misc_feature (802)..(802): n is a, c, g, or t
  misc_feature (845)..(845): n is a, c, g, or t
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccnttggcttgggcttcctcacctcgagtttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctntgtcggtgctgatctcagnggntgctgtcttggggaaggtcaacttggcgcagttggtggtgatggtgctggtggaggtgacagctttaggcaccctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagagagcaacgatacccagtttgtctgccatgctgggcgccctcttcttgtggatgttctggccaagtntcaactctgctctgctgagaagtccaatcgaaaggaagaatgccgtgttcaacacctactatgctgtagcagtcagngtggtgacagccatctcagggtcatccttggctcacccccaanggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 296606 - DNA, 960 bp, Homo sapiens
tatatatccaagatctcttccaattcagattttatgaaagaatttctaaggtctttgtaatgagacatttaggctgtttcaagaggtcaagccaaaatcagtatgtgggttcatctgcaataaaaatgtttgttttgcttttacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttaatttttttttttcttttgtaatttctttttatttttacaaattataccatgataaaatttgacaaaaattattcatgtgaaagtttcctctaacattttataagttaatcaagtgcataccacaatagatttttggttgttgtttaggtgttctcgtgattttagtattacacaactttaagctgagactacactcagaaataagtttagaaaatggcattacaaaaggttgggagtgagcagtaaaaaaacaaacaaacccatgcagggctgttgtgctgtgggaaatcagatgtgttcactgccataagtcttcagtgcggccaaacttaaaaaccagccctcccaaaaaaggatggaagggcattctgggggaaaaatacagcaattccagggggggtatacctatggtcctttttttcctttaggggccacccattacccctcc

SEQ ID NO: 296607 - DNA, 452 bp, Homo sapiens
tatactatatttcacagtcaaagatagtcaagcgtacggaagtcagctagaggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 296608 - DNA, 450 bp, Homo sapiens
tttcttttcatgacttatttacaattcacttattttaataattaacaaaggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 296609 - DNA, 519 bp, Homo sapiens
tatactatatttcacagtcaaagatagtcaagcgtacggaagtcagctagaggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaagcaacataacctccaaaaagaatccacatagatgcaatcagagatccaaaggccaacatgaaaccaacgaaaagccaaatgcgagcaccttcaaagaaataatattttaccagaattctttcttatagggcagtacaattaactttcaaaaagaaaataaaacc

SEQ ID NO: 296610 - DNA, 304 bp, Homo sapiens
attgcactccagcctgggcaaagcctgctgggttgggctgggtaagctctgaacaccagtctcgtggcttcaagtcacacctcctaagtgaagctctgaactttctccaaggaccatcagggctttcccctgggcagaggatgccgacactcactgctcttactgggttttattgcagacagactaccacatgaacatgatgcacatctacgtgttcgcagcctattttgggctgtctgtggcctggtgcctgccaaagcctctacccgagggaacggaggataaagatcagagagcaacgata

SEQ ID NO: 296611 - DNA, 1399 bp, Homo sapiens
cgcgcgggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagaga

SEQ ID NO: 296612 - DNA, 2630 bp, Homo sapiens
cgcgcgggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgaccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaa

SEQ ID NO: 296613 - DNA, 3276 bp, Homo sapiens
cgcgcgggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgaccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaaaaaaaaaaaaaaaaaaaaaaaaaaaaaaaaaaaaaaaaaaaaaaaaaaaaccaaacaaacaaaagcaaacagcaacctaacacaagcaagagaaaataaaaaaataaccaaaaacaaaacgcaaagaggggagggggcgccctagataaacagaacccgcgaagagcagcaacgacacaaccgaccagacaacacccgatcagttcactgagaagagcgccgcacacagagtgagatagatataatacaaagaaacgaccagcggcgtaatcgacacgaatggagggagaaaaaaacgcagcgccacgcactgctataagagaaagacaccaccggttgagggcggctggaaggtacgacaccacccccaacgaatgaacgccgaagcacgaaaaacacacacagatgacgtgtgcagacaagcacagcattgccgggaagcacaagcgctcagactagagtatggatcatatacggaggggcggaataacacggcgggagagaggagacaaccgaaccacaagcacgcagacccagccgccggacgcacaacacggcacaaccagcgaacagagacgacggtcgacgcaagcagcaaggcagcggaaatagaaagaaaggaagaggacaagacggagaagagaac

SEQ ID NO: 296614 - DNA, 2946 bp, Homo sapiens
cgcgcgggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgaccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaagtgagtcacatgaagttttttggttttcccctgcatataaaagttacatttacaccatcctgtagtctattaagtgtgcagtagcattatggctaaaaaaaaaaaacacccaatatacctatcttaattaaagaattatttattgctgaaaaaagctaatgattatttgagccttcaacaagtcataattttttgttggtggagggtcttgccttgatgttgatggctgctgactgatctgggtcatggttgcggaaggttggggtggctatggcaatttttaaaaataagacaacaataaagtttgctgcattga

SEQ ID NO: 296615 - DNA, 2576 bp, Homo sapiens
cgcgcgggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgaccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagatttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaa

SEQ ID NO: 296616 - DNA, 2576 bp, Homo sapiens
cgcgcgggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgaccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaa

SEQ ID NO: 296617 - DNA, 547 bp, Homo sapiens
gataatacagggggataggcttatggagggccctgagaatccgtacctgctactctgggagttttagagtcagggaatgacacaatgtaaacacactgtggcatacgatgttaccttatgtgttttctttctaagtccctgtatagtggggactttctcatgtttctctatgttccccacatatttgttaaatgcatgttaaatgaatggtgggcttcttaaattatatttttgtggattttattcaggtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaaggtgaatttcttgatccttgtatcagtttcattttcacgtgctctctgttactgtgcccctaccctccagttccttaacgttttgtggaatcttgggtgttcttacctgtcctagtcatacttttgtgggggaaaaaaaagaa

SEQ ID NO: 296618 - DNA, 625 bp, Homo sapiens
gaggaatgctgagtaaaggcagaggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcattcctcgcaacagctgttgcgaggaatgctgaggaagccacaagggaggacatttcctgcagttgccgaaccagtagcaaccaggtcctgagaaagccctctcttgtggaagaataactgccaagcaggaaagcttttcattctgcaaagctgggacagaaggttcttccttgaatgtggtcatctgcatttcagctcaggaatcctgttggctgaagtccagagtgtcctttctgattcctgaagtagatgaacagcccaggcaccacaaggaagagcaggcccagcacgaagcccccgactccactcagcattcctcgcaacag

SEQ ID NO: 296619 - DNA, 4666 bp, Homo sapiens
cctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcgtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296620 - DNA, 4492 bp, Homo sapiens
cctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcgtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgtagactgattgggtcctcggg

SEQ ID NO: 296621 - DNA, 5011 bp, Homo sapiens
cctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagtgtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296622 - DNA, 4725 bp, Homo sapiens
ggatcccccgggctgcatgaattcggcaccagggagactgaagttcacgttccgctcttagtgcgcggtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296623 - DNA, 4568 bp, Homo sapiens
ggatcccccgggctgcatgaattcggcaccagggagactgaagttcacgttccgctcttagtgcgcgtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296624 - DNA, 4756 bp, Homo sapiens
ggatcccccgggctgcatgaattcggcaccagggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagttgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296625 - DNA, 3230 bp, Homo sapiens
ggatcccccgggctgcatgaattcggcaccagggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagttgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296626 - DNA, 4433 bp, Homo sapiens
cctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagtgtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaataaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296627 - DNA, 2096 bp, Homo sapiens
ttttcttttttggccctttgacattttctttgttatcttggagcttggtcaccagcatttctagacattttgtagcagaagagttttcaagttatttcttcttctatattcatctcttaatcaggttttcttcacactccccacattttatgcttcctttcttagcatgaagattggtgacttttttccccaactttctcttaggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296628 - DNA, 1374 bp, Homo sapiens
gctgctatgaatatgagtatacaaatatgtcttccagacactgctttcagttctttcgggtatatacctgaaagtggaattctggaatcatatgggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaactctt

SEQ ID NO: 296629 - DNA, 3895 bp, Homo sapiens
cctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagtgtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattggtggtgctggttgtacaata

SEQ ID NO: 296630 - DNA, 3688 bp, Homo sapiens
cctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagtgtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctaagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaaatggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggtatgtcaatcctaactggttactcttggttgtcaatttttagaagttactccagacctctcaacaaaaaaatttggtgaacctttcaatgatcatatatttaatatgtgattccacttagttgtcacatttgtggagtttttgtttttgtttttgttttttacctatagcccttgatatgttatgaaatcacaattaagaataaactataggcaacttttctatttc

SEQ ID NO: 296631 - DNA, 664 bp, Homo sapiens
ggatcccccgggctgcatgaattcggcaccagggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagttgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggtgagaagcagtcccattctttgtgtatgtagtgagatac

SEQ ID NO: 296632 - DNA, 443 bp, Homo sapiens
cagtagctatcccagtgggtgtcaggtactatatatctcattgtggttttgatttgcatttttctaatgattagagatgttgagcattttttcatatgcttattgaccatttatataattgtctttggagaaatagctattcaagtcctttgcccatgttgaatcaggttgggtgttttcgttgttgttgctgtaagagttctctgatattctggatattaacctcttatcagatacatgatttgcaaatattttcttccattctgtaggttgccttttcactctgtgcattgtgtcttttaatgcacagaatcagtcaactttttgaatcctctgaaactctgtagtttttaagttttctgtgaagaatgaacaatgacaactaaatttgcttgtttcttttctttgggatttcagggccttgatacaaagcatgcttgaaa

SEQ ID NO: 296633 - DNA, 377 bp, Homo sapiens
acttctcttcacatgtttttagtgcacgagcatagctgtgtctcggaaatggttggctttgggcagttcaggaggaggactccatctcattcagaaagaaggctggaagcacaggctttttctttcacacagggtaagattaagggcagctctgtcatacaccatttggagtctctttcataaatgcaaatttctccaatataaataatcatttggaataaaagaatgtagaacttggcttggtgcggtgtctcacgcctgtaatcccagcattttgggaggccaaggcggatggattacctgaggtcaggagttggagaccagcctggccaacatggtgaaaccccgtctccactaaaaacacaaaaattagctgg

SEQ ID NO: 296634 - DNA, 535 bp, Homo sapiens
tgttgtgccctgttggctggcttcctcgccatcgtgccacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296635 - DNA, 649 bp, Homo sapiens
tttaaaaaaaaaaaaaaagaggagtgaggagtgtgcccagagcctgtgtgtgtggcagtggggaaaaggcacacctggcctggaggagccagcagggggagccccggcctggagtgtctctgcggggtgagtcctgggagatcctgtttcaggtggggcagggccaggttcagggtggggacaggcagaaccttccctgaggaagagggagtggtgtcatacctacctcggggtagacactcctcagtgacatcagtgctcttcccaccttttccaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296636 - DNA, 647 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacagcaacaattccacaagcggtaatcttttttctccgggggggggagaaaaaaaaagggcccccccgtttttttttgggggggggggggtggggcccttccccccccaagggaagggcccgtggaaaaccccccggggcctatgtggtccaactttggttgggggggggcagaccgcaatgtggcccctatgtctggagtcagaaagatggtgttcggaagccaaccctggtgatcctgagaattaatccggcccccggggggcccaagggccttttaaccctttttttttttggtttggaaaagctggggtccccacgcta

SEQ ID NO: 296637 - DNA, 753 bp, Homo sapiens
aatgtgctgggattacaggagtgagctaccgcacctggcccgtaatatttaaagtcatgcagcacttactgaatttccttaaaattttaaagaaaatactataatgatcttagttgttaagtgcttcttgtggccccagctggtacccagcactctaccgttgctatggaaagcactgaacctaccctgaggactaaagagctaaaattaggagatgagacgtgaaattgaaagctagataacatgaaaatgtagacaacacgaaaacgtgcgccaaactatttccaagtgtcttccaaaagtttcctttgtgtttttagggtaaggaagactttccagaatattgagaagaacaaagtaatataataaacacccatatcagataatcgccaccagaattaccaactttttccctgtgccaggaagtaatttcttttcctgtatcaggaaacttaaggaaaaaggatgtaataataaggaatattattcttgatgatggtaaagtcacctctcaccagcagtcctattcctctcccctggaaggcagactataatttgctatgacaccattccagtccatttttaatacatttacatacatacatattcataaacaagcttaggccaagcacagtggcttacacctgtaatcccagcactttgggaggctgaggcgggaggatcgcttgaacccaggaatccaagactagcctgggcaacataatgagaccccccgttagcacggtgtggtgg

SEQ ID NO: 296638 - DNA, 1604 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296639 - DNA, 1940 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtgaaaaaaaaaaagggggggggcgaaaaaaattcccccggggggccccaagtagttacacagtaataccggttgttttgtcgacaaagggggcgccccatataggggggatgataaattagagagaggcgcggggccggagttaaaaaaaacggcggcaacggagagaacctcttcgctcctggggcaatctttggagaaaaaccaccaatattctcgggcggggggcgacattttcgcgacactcccaagaagaattaacggcccggggaatatatactttagggtggtagtggggaccaaacacaaatattcgccggaaaaaattcgtctaagttt

SEQ ID NO: 296640 - DNA, 2163 bp, Homo sapiens
  misc_feature (1616)..(1616): n is a, c, g, or t
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtgaaaaaaaaaaanaaaaaaaaaaaaaaaaaaaaaaaaaaaaaaaaaacaaaaaaacaaaacaaaaaacagcaaccaaaaagaaaaacaagaaaacaaaaaaaaacaggagggggggggcgccagctgcaaaatccgccccgagcagggagcgcccaatatataagaccacccaccaggtgtaaaaaaaaagggaggcccaccataagagaggacaaatataaaataggacgggcacgcggagtcataacaaacggatatggagaagaaacaacacatgtgataggggagagaacaatagaaggagaaaacacaacatagtggggggaggaagagcacattacgttagagtagaaacaaacacctccatagtggatgaaagttatgatgttacctgctccgggggtgtgagaaattatacaaacaagtttgtgcgattagttatgatatgtagttggtgaaaaaaaaaacagttatatatctaatctggtgctcggacgaagaaaaagatttagtttatcgtcaaagacgagaattatgtagtatggagaaaatattttag

SEQ ID NO: 296641 - DNA, 1643 bp, Homo sapiens
  misc_feature (1613)..(1613): n is a, c, g, or t
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtgacacacaanacaacaggggggccgccaaaaaaaatcccg

SEQ ID NO: 296642 - DNA, 1973 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtgaaaacacaaacacacaacaccgccagaccacaagcagacagaccacaaagcacaaccatgttgggcgcggcgccccctggcgcccctggaaaaagaagccttttacagaaacccatcgtcgtggggggggcgcggggggcccccacgtgatgctacgcgtcaaaccagggcgcggcacaggtggttgccgaagagaaaaacctgcgggcgcagaagcaacaagggcgcgggcgactccccacacagattataaaaaagcccccggggggaccacgccagcgcgttgcggacaacaacaccagaggggatgcccaaggacacacgagggctaacccacgggagcccaggggcgcccatatcaaattagcg

SEQ ID NO: 296643 - DNA, 2332 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtggttttggttttgtttccttgtagtatttcaatttttagtagaaaaatatgagcgaattcttcattcgattcagttttttttaggcaaaatcttagatccttggtttcttaaattgtaccattctatacaaccttgaaccaaaaagcaccatttagtgaggggtgagagagaaccgtttctgaacattgcaatacttctgcaaagtaggttgtgtcggtctgttttgtgttgcaataaaggaatacctgaggctgggtaatttgtttaagaaaaaagatttatttggcacacggttctgccggttggacaagaagcatggtgcctgcgtctgcttttggggaagcctcaggaaggttttactcatggcagaaggcgaaggggaagcaggcgtgtcccatggcgggagaggatgcaagagagagtggggaggaccaggctccttgaaacaaccaggtcatagagtgagaacacactcattcctgccagggggcaccaagccattcatgagggatccgccccatgacccaaacaccgcccaccaggccccaccccaacactgaggatcgcatttcagcgtgagatttggaagggacacacagccaagccctgtcagaggtacaccgttcccgtcttgcatgtgagcaacagagaagcccacctccactgagcagccaagcccgaatgggagcctgccctgggaggccctggggcccggtgcccacagcatg

SEQ ID NO: 296644 - DNA, 1807 bp, Homo sapiens
  misc_feature (1440)..(1440): n is a, c, g, or t
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgaaaaaaaaaaanaaaaaaaaaaaaaaaaaaaaaaaaaaaaaaaaaaaaaaaaaagggggggggcgaaaaaaattcccccggggggccccaagtagttacacagtaataccggttgttttgtcgacaaagggggcgccccatataggggggatgataaattagagagaggcgcggggccggagttaaaaaaaacggcggcaacggagagaacctcttcgctcctggggcaatctttggagaaaaaccaccaatattctcgggcggggggcgacattttcgcgacactcccaagaagaattaacggcccggggaatatatactttagggtggtagtggggaccaaacacaaatattcgccggaaaaaattcgtctaagttt

SEQ ID NO: 296645 - DNA, 1288 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagacctcgagtcttcccatccagggcctcccgataacacgttcgcgaggtaccgcta

SEQ ID NO: 296646 - DNA, 1211 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactctatgtctctattagtgagctagacaagcaatatctctctaatttccactacagacagtgacgactag

SEQ ID NO: 296647 - DNA, 1434 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtgcagattacaaggcagcagccagcaggagcagtgcagaccttgttgcaatctgaggtggtggggcctcagggcagctgcttcctagggtaccctttctcagctactcgagaacaaaaggagacattcctgaatgctgcgttcccacagtagtgcacacataacagaaagcgaagttacagcctgttggaaaaggtaactgtagctgtcgtttcaagtaatggatacaaataagaagattatttaattaaaggaacagaatttcttatcatcatgatgacaaagctgagga

SEQ ID NO: 296648 - DNA, 1573 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttgtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296649 - DNA, 1496 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactgagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296650 - DNA, 982 bp, Homo sapiens
  misc_feature (24)..(24): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (34)..(34): n is a, c, g, or t
  misc_feature (36)..(36): n is a, c, g, or t
ccgttgcgtgactgactctcttanttncnancgntncagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296651 - DNA, 1391 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296652 - DNA, 1548 bp, Homo sapiens
  misc_feature (1181)..(1181): n is a, c, g, or t
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcagtgagtatttgcctttcatttggaaggtggggaacaaggggtgggatctctcaccagctgaaccaggactgcccttcctggggtgttagcacagggcacaaacataaaaaccttaatcaggccaggcgtggtggctcacgcctgtaatcccagcactttgggaggccgaggtgggtggatcacaaggtcagcagttcaagaccagcctggccaagatggtgaaaccctgtctctactaaaaataaaaaaaattatccaggtgtggtggtaggcgcctgtactcccagctactcggaaaaaaaaaaaaanaaaaaaaaaaaaaaaaaaaaaaaaaaaaaaaaaaaaaaaaaagggggggggcgaaaaaaattcccccggggggccccaagtagttacacagtaataccggttgttttgtcgacaaagggggcgccccatataggggggatgataaattagagagaggcgcggggccggagttaaaaaaaacggcggcaacggagagaacctcttcgctcctggggcaatctttggagaaaaaccaccaatattctcgggcggggggcgacattttcgcgacactcccaagaagaattaacggcccggggaatatatactttagggtggtagtggggaccaaacacaaatattcgccggaaaaaattcgtctaagttt

SEQ ID NO: 296653 - DNA, 872 bp, Homo sapiens
ccagtgggagccgcctggcagagaagcttaccccggtggagccagccaccagtgccactggtctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296654 - DNA, 884 bp, Homo sapiens
gcttagaattcgacggtttctcaaagtgtggtccttggtactggtccatgaattggttgctaccagtcaatgaagagataaattacttgcatcagagtgtaaatcaatacattgctttagctattaataaaattttgctaaaaaatcaaatcctgtcattgacctaaaaagtatctctagatttaaattcttgtgcatgcttatcttgcctgtggataagtaacagttggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296655 - DNA, 845 bp, Homo sapiens
  misc_feature (794)..(794): n is a, c, g, or t
  misc_feature (796)..(796): n is a, c, g, or t
  misc_feature (804)..(804): n is a, c, g, or t
  misc_feature (808)..(808): n is a, c, g, or t
  misc_feature (810)..(810): n is a, c, g, or t
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagctnanctctcgcngggnancgctgctggtcaccgaacccgttggggacccaagg

SEQ ID NO: 296656 - DNA, 797 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaactgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296657 - DNA, 444 bp, Homo sapiens
cggcacctcgctattcatcggcacctcgctattcatcggcaccgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296658 - DNA, 489 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtg

SEQ ID NO: 296659 - DNA, 761 bp, Homo sapiens
ttccgggatctgtcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacagggtaaggaagactttccagaatattgagaagaacaaagtaatataataaacacccatatcagataatcgccaccagaattaccaactttttccctgtgccaggaagtaatttcttttcctgtatcaggaaacttaaggaaaaaggatgtaataataaggaatattattcttgatgatggtaaagtcacctctcaccagcagtcctattcctctcccctggaaggcagactataatttgctatgacaccattccagtccatttttaatacatttacatacatacatattcataaacaagcttaggccaagcacagtggcttacacctgtaatcccagcactttgggaggctgaggcgggaggatcgcttgaacccaggaatccaagactagcctgggcaacataatgagaccccccgttagcacggtgtggtgg

SEQ ID NO: 296660 - DNA, 549 bp, Homo sapiens
tattgcacaggtgaatgaaactgtcaaacatttttaccctgatctaaagttattttagctaagtacactaacattgtttatttttcgctggttagaatcattaattgacagttgtacgtgtctctgggaaaatgaattttaatcttagttttcctgtaaagcattataaaatacagggtccaagtaaaggttaaaaaaaaaatggaattattcagaggtgaatttgggaactactttttcaaaagtttttcttttccttactatagtctgcttttaaaacaactgtgacatgtcccctttttggtgacaattgcaagttcaggtgttaactgttgtttgacttgtgtctccagagattgccctcagtcccaataatcacgaagtgcacatctataagaagaacgggagccagtgggtgaaagctcatgaactcaaggagcacaacggacacatcacagggtaaaggaagatagccgtgagcttagtgtgatatttccaaatcaggcactcttccttttagataaagagcctaataaacccaggtggcca

SEQ ID NO: 296661 - DNA, 345 bp, Homo sapiens
gggtttctccatgttggtcaggctggtctcgaactcccgacctcaggtgatccacccacctaggcctcccaaagtgctaggattacaggcttgagccaccgtgcccagctcatgttttatttttttttaatgagtcaacctctttgcattctgagattccttgtggcagctgcctatggcctgtttctatatacatatattttcatttgctttttccttttctctctgccctttaaacaagtgttttctgcctacattaaagaagtggatgaaaagccagccagcacgccctggggcagcaagatgccttttgggcagctgatgtcagagtttggtggcagtggc

SEQ ID NO: 296662 - DNA, 761 bp, Homo sapiens
aggatacaggaaatacggtaagagcgaaacaggaggaagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaa

SEQ ID NO: 296663 - DNA, 748 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaa

SEQ ID NO: 296664 - DNA, 1625 bp, Homo sapiens
aggatacaggaaatacggtaagagcgaaacaggaggaagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296665 - DNA, 1549 bp, Homo sapiens
cggacgcgtgggtcgacccacgcgtccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296666 - DNA, 412 bp, Homo sapiens
cctggaccggaactcccggggagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaa

SEQ ID NO: 296667 - DNA, 1169 bp, Homo sapiens
  misc_feature (38)..(38): n is a, c, g, or t
gccactctgctcccactcctcgccacttcgacgaaaancatccgcgaccttagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296668 - DNA, 305 bp, Homo sapiens
  misc_feature (38)..(38): n is a, c, g, or t
gccactctgctcccactcctcgccacttcgacgaaaancatccgcgaccttagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaa

SEQ ID NO: 296669 - DNA, 448 bp, Homo sapiens
aaagatcatctagcaaagccttttttcccagctacatataaggaatttgaaagtcacataaaatggttaagaaaatgtgccaagattacctcagtaattctggtctgtgttctcaggagaccctggaaataaacaatgaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296670 - DNA, 391 bp, Homo sapiens
gagaagcactgctgcctatgcactccatttacagggttatagagtggaaagtcccacaatctttttcttctctattttcagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296671 - DNA, 607 bp, Homo sapiens
tgatttggccgacggtcatctgccagattctgatgatgattcagaactcagtgtggaagaacatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgtgggtgcacagaggaaaggacgctcagcctgaccttcccggggctgtccgtgccagcgctccgcgtgagggaggggcccgctcctgcttggtgagagagtcagcacgcggtggcctgggtaatgtttgcatctgggtgtcgttttcggccattctcacactgttataaagaaatacttgagaccagtctcactctgtcgcccaggctggagtacagtggagcagtctgagaatcacttgaacccaggaggcagaggttgcagggaacagatatcgtgccactgcactccagcctggatgactgagcaagactccatctcaaaaacaaaaacaaaaacaaatacaaaaaaaaa

SEQ ID NO: 296672 - DNA, 362 bp, Homo sapiens
cggcacgagggatgttggagcggccgcaaatgtttttcttctctattttcagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296673 - DNA, 480 bp, Homo sapiens
aaaaagggggaaggtgggaggggatgagggtggaaaaattacctatctggtattatgttcactgtttgggggttagaaggccaatccccaccgctaggcaatatatccacgtaacaaacctgcacccttatgccctgaatctatttgtttttcaacattgacttccatggtcactatttgtgaaatcactcctcatgaaccaggacttgcatgtttttttgtttctcaggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296674 - DNA, 592 bp, Homo sapiens
cgcgactctcgtacacgacgtattgcaccagaacagagtagaccttgtggaatgactcagtcaggactcactgcaatacggaagagtaggagcttaacttcatcgaaacaaaaggctggggagtttttaagtgccggggtgagatgctgagaaggaactggagacatcaggaagaggttaggaaatgccgtagagctatctgcgttggctcattggaatttttcaaaactgggaatctgcccttctacaaaaactgagacacagatgtatcatctccttcaataattgcattttaaagggatggctctgaagtcttgagaaaggcattcctgggttgcaaaactaggaggaggctagaagaaaatttgggagaagatttgcctctcaaagaggtagagaaagaactcacaattgcaagtttcctaaaataaatcctccgtgaaaaaaggaggcctgatggatggaactggaggtcattatgttgagtgaaataagccaggcacagaagaaaaatactgcatgttctcactcacatgtgggagcttaaaacctggatctcatgaagattgagagtaaattggtagctaccaga

SEQ ID NO: 296675 - DNA, 465 bp, Homo sapiens
tgcggtccgagccacactccctctgaaggccagcattttaaacttaatccaggccatggccagctggaccctgagatggtgctatctgagaaagccaatgggagcaccctccgtgggtgcacagaggaaaggacgctcagcctgaccttcccggggctgtccgtgccagcgctccgcgtgagggaggggcccgctcctgcttggtgagagagtcagcacgcggtggcctgggtaatgtttgcatctgggtgtcgttttcggccattctcacactgttataaagaaatacttgagaccagtctcactctgtcgcccaggctggagtacagtggagcagtctgagaatcacttgaacccaggaggcagaggttgcagggaacagatatcgtgccactgcactccagcctggatgactgagcaagactccatctcaaaaacaaaaacaaaaacaaatacaaaaaaaaa

SEQ ID NO: 296676 - DNA, 739 bp, Homo sapiens
gatgcaaacggccacacagtcatggattcacaatgatctgggtctccatcatcctgcaatccaacaccttgcacagccttcaaacaccagctgggaattcaaaagtggcatgtgcggtagcaggagatctgttcaccctcttatttcctctcatccccatgtagcaatctggtgcaatcacagctcacagcaacctcaaactcctggactcaagtgatcctacctcctcagcctccctagtagctgggactacaggtgtgtgccaccctgccagactgatttttgtagaaacagagtcccactaggttgcccaggctagtctcgaacttctgggctcaagcaatcctcccgccttgcaaatacagagtttgataaaagacctcctgaggtcctacagagagaagtctttaagctccagggcagagacaatttgcatttttctcaccacccagggaatgctaactgggcagcccagggtacccgggagctcaggccatccagtgtcctttgagatgttaggaggaagcagaacagccagctgccaaatgaaacacggcaaaatgctcacccttcaagggtctgcttttgttttgtttttgttttttgagacagtctcactctgtcgcccaggctggagtgcgctggtacaattttggctcactgcaaccaccacctattggattcaagcaattctcctacctcagccttccaagtagctgggactacaggcacgcaccac

SEQ ID NO: 296677 - DNA, 953 bp, Homo sapiens
aggatacaggaaatacggtaagagcgaaacaggaggaagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaaaaaaaaaaaaaaaaaaaaaaaaaaaaaacttgtgtgggggcggctggggcccgagaaaaagtttttaaacccattcggttgtgggggcgcggggcgccccatagggttagtggaacccgttggcccaaaaggggtttcccaggaggaaaaaccgggggccagaaacaggtggggtggggttttctcccccaa

SEQ ID NO: 296678 - DNA, 1693 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcagtggcctgcagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296679 - DNA, 1772 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggtctgctggagttttgctggaggtccactccagaccctgtttgcctgggtatcactagcggaggctgcagaccagcaaagattgctgcctgttctttcctctggaacctttgtcccagagagacacctgccagatgccagccagagctcttctgtatgagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296680 - DNA, 1784 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcagtggcctgcagcaatctggtgcaatcacagctcacagcaacctcaaactcctggactcaagtgatcctacctcctcagcctccctagtagctgggactacagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296681 - DNA, 1896 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcagtggcctgcagggttatagagtggaaagtcccacaatctttttcttctctattttcaggtagatgcattttattactatattctatctatccatttattccatctatctattccatttatcatctacctacctattattatctatcatctatgtattccatctacctgtcattgatctatctatcatctaccaatctacatttttgtcttgtagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296682 - DNA, 1740 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcagtggcctgcagggttatagagtggaaagtcccacaatctttttcttctctattttcagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296683 - DNA, 1634 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcagtggcctgcaggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296684 - DNA, 908 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggtctgctggagttttgctggaggtccactccagaccctgtttgcctgggtatcactagcggaggctgcagaccagcaaagattgctgcctgttctttcctctggaacctttgtcccagagagacacctgccagatgccagccagagctcttctgtatgagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaa

SEQ ID NO: 296685 - DNA, 1421 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaaggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaagcactgctgcctatgcactccatttacagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296686 - DNA, 1887 bp, Homo sapiens
ggtggcggggcacgcccaggtctctggctcctgggctgggtcgcggcaggggcggagcgcgtgcgaaggcgacgcccccagcccctaggcctcgcccaggcggcttccgcccgcctcttcaacgcgcacgctgctaccgagctgcaggaggccgcgggcgcgagactgggaatgcgcagggcccccgcctggctctacaagcccgggccgcggcccccgccttccccgccgcctcccggcgctccgtgcccgccccacgaggccggcggctgctgctacctggggccgttgctgcttgtgccgtgagcgacggccagccattgtccccgccgctccgtcagccgcgcccggccgcgcgcgcaccggaaggcgcattggcgtcttgcgggctccgggccgggtgggcaggatggcctccacaagccgcatggcgcgcatggggagcctccgttgatgccgccgcgccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaaggtaacgtctggagaaacaaaaggtcaggaatgaccaacgtccctactggccacagtccagccccaatctgcaagacagagccagccgccccgggggaattcccgcctggtgggactccacgtcaccagcccccagctgctcagggtacagcccctcgtgagaactgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcagtggcctgcagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296687 - DNA, 1560 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctgttttgttctttctgctatctttcagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296688 - DNA, 1475 bp, Homo sapiens
cggacgcgtgggtcgacccacgcgtcccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296689 - DNA, 1158 bp, Homo sapiens
ccctgtgtgcgaagttcacgcgaagtacccacccgcttccgctcttatgatgtaatcagcacgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcaggtaaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaatcacaaatggaggtatggtgacatttatgtatattctagagttatgttatgcacacttaataa

SEQ ID NO: 296690 - DNA, 905 bp, Homo sapiens
gagactctgtctcaaaaaaaaagtccatgaatgaaggagaatgtttttagtaatgatattttcctagtcagcctcattttagcttcttcccatcaagtgaaatttttttttcttaaagcaataaatgcgaccgcacctggcctgtgtatttaccttgtatgctactacattgctgatttcatttattagtttttttttttttaattcttttttaaaaaagaaaaaacagacacagtctgggcgacagagggagactccgtctcaaaaagaaaaaaagcaataaatgctcttccagaaaactcaaaaatgaagataagctaaaagaaaatggaaagcaccagaataccagaatctttccactcactgatgatcagagttaatacctcagtgtcttctgtggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296691 - DNA, 1029 bp, Homo sapiens
ggtggcggggcacgcccaggtctctggctcctgggctgggtcgcggcaggggcggagcgcgtgcgaaggcgacgcccccagcccctaggcctcgcccaggcggcttccgcccgcctcttcaacgcgcacgctgctaccgagctgcaggaggccgcgggcgcgagactgggaatgcgcagggcccccgcctggctctacaagcccgggccgcggcccccgccttccccgccgcctcccggcgctccgtgcccgccccacgaggccggcggctgctgctacctggggccgttgctgcttgtgccgtgagcgacggccagccattgtccccgccgctccgtcagccgcgcccggccgcgcgcgcaccggaaggcgcattggcgtcttgcgggctccgggccgggtgggcaggatggcctccacaagccgcatggcgcgcatggggagcctccgttgatgccgccgcgccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296692 - DNA, 677 bp, Homo sapiens
gcatggcggcaggagactataatcccagctatttgggagattgaacccagaaagcggaggttgcagtgagccaagatcacttcactgcactccagcctgggcgacagagtgagactctgtctcaaaaaaaagaaaaaaaaaaagcattgaaacatgcgacatccacctttttgtaatagttcccatagcctacacaaatgcatatgaaatgcttaatattttgcttgcactattcttttctgctggaagggtggttctgactaaaaaattttactttcccattctttgctttttcattaatgctattttctttgctccagggttatagagtggaaagtcccacaatctttttcttctctattttcagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296693 - DNA, 465 bp, Homo sapiens
cgagctcggtaccctggcaaggtggaaagaatgactcagtcaggactcactgcaatacggaagagtaggagcttaacttcatcgaaacaaaaggctggggagtttttaagtgccggggtgagatgctgagaaggaactggagacatcaggaagagaaaaacgttgacctcttggcgagaatgcaaagaagggaacgcttgcttatacactgttggtgaactgtcacccctacaactcagcttgcaaccagccctggccaccagtttccccacactgagctgaatatcggacatgcccatcttagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 296694 - DNA, 360 bp, Homo sapiens
gggaacaatgaggctgattgattagttttggaagcctaataaaacaagagtaatagcggtagacatccctgtactttttgggggagaaatatgcctaagataatagaaacatctggtccacctaacagataaattattttgcattcaaatacattagataccaaaaagatgcaggttattgacattgtatgcctttgatttaatatttattaagcactcatctaataattttgcattctctttaacttgcttaatagggaaattggggtgttttctgctcaacagacatatctgacctgtatgataatggaatttctcattataagtcaataaacttttgttctttctgctatctttcag

SEQ ID NO: 296695 - DNA, 7225 bp, Homo sapiens
aaaggttctaaatgtctgcggggctcagagccggatgtcacgtcgtcctcctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgccgcgccctctgcgcaaggaggagactcgacaacatgtcacccgcgctccaagacctgtcgcaacccgaaggtctgaagaaaaccctgcgggatgagatcaatgccattctgcagaagaggattatggtgctggatggagggatggggaccatgatccagcgggagaagctaaacgaagaacacttccgaggtcaggaatttaaagatcatgccaggccgctgaaaggcaacaatgacattttaagtataactcagcctgatgtcatttaccaaatccataaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaagaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaactttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggttttttttttttgagacagagtctggctctgtcgcccaggctggagtgcaggggcgcaatctcggctcatagcaagctccgcctcctgggttcatgccattctcctgcctcagcctccagagtagctgggactacaggtgcccaccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagaccttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatgtattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaaaaaaaaat

SEQ ID NO: 296696 - DNA, 581 bp, Homo sapiens
aaaggttctaaatgtctgcggggctcagagccggatgtcacgtcgtcctcctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgccgcgccctctgcgcaaggaggagactcgacaacatgtcacccgcgctccaagacctgtcgcaacccgaaggtctgaagaaaaccctgcgggatgagatcaatgccattctgcagaagaggattatggtgctggatggagggatggggaccatgatccgcagcttgggcttggcaggttgggccccgacagcccagaaggctttggtactggcacgcacag

SEQ ID NO: 296697 - DNA, 7094 bp, Homo sapiens
aaaggttctaaatgtctgcggggctcagagccggatgtcacgtcgtcctcctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgccgcgccctctgcgcaaggaggagactcgacaacatgtcacccgcgctccaagacctgtcgcaacccgaaggtctgaagaaaaccctgcgggatgagatcaatgccattctgcagaagaggattatggtgctggatggagggatggggaccatgatccagcgggagaagctaaacgaagaacacttccgaggtcaggaatttaaagatcatgccaggccgctgaaaggcaacaatgacattttaagtataactcagcctgatgtcatttaccaaatccataaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaagaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaactttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggttttttttttttgagacagagtctggctctgtcgcccaggctggagtgcaggggcgcaatctcggctcatagcaagctccgcctcctgggttcatgccattctcctgcctcagcctccagagtagctgggactacaggtgcccaccaccacacccggctaattttttgtgtttttacaaaatacaaaaaagtagagacaggatttcactgtgttagccaggatggtcttgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagaccttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatgtattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaaaaaaaaat

SEQ ID NO: 296698 - DNA, 7064 bp, Homo sapiens
ctctgggcccaagcagtcctcctgccttagccttccgagtagctgggactacgggcatgtgccaccatgcctggctaatttttcgtgttgttttggttagagacagggtctttctatgttgcacagactggtcttgaactcctggcctcaagcagtcctctcaccttggcttcccaaagtgctatgattacaagcgtgagccaccatgcctggctgatgtgttaccttatgttagcatatagctaccctgtgaagtagggttataatatatttgaatgaagagactgagactcagagagtttaagggacttgattaagttcttataaccttagcatgttaacattgtctgaattcaagtttcgtgtttatttattcataccacgtgcctttctgtgaaatccttacacctttttgcatctctaccttctaatgcagtgccttactcttagtaaatggtcaaaaggtagctgctgataatggtggtaatgaaagggcatgtttattctgggggcacaagaaactctaaagctcataattgacattataatctcttgttgcaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaaatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagaaacattacctggagccagaataagtggaggtctttccaacttgtccttctccttccgaggaatggaagccattcgagaagcaatgcatggggttttcctttaccatgcaatcaagtctggcatggacatggggatagtgaatgctggaaacctccctgtgtatgatgatatccataaggaacttctgcagctctgtgaagatctcatctggaataaagaccctgaggccactgagaagctcttacgttatgcccagactcaaggcacaggagggaagaaagtcattcagactgatgagtggagaaatggccctgtcgaagaacgccttgagtatgcccttgtgaagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttataaagtcagcccgggttatgaagaaggctgttggccaccttatccctttcatggaaaaagaaagagaagaaaccagagtgcttaacggcacagtagaagaagaggacccttaccagggcaccatcgtgctggccactgttaaaggcgacgtgcacgacataggcaagaacatagttggagtagtccttggctgcaataatttccgagttattgatttaggagtcatgactccatgtgataagatactgaaagctgctcttgaccacaaagcagatataattggcctgtcaggactcatcactccttccctggatgaaatgatttttgttgccaaggaaatggagagattagctataaggattccattgttgattggaggagcaaccacttcaaaaacccacacagcagttaaaatagctccgagatacagtgcacctgtaatccatgtcctggacgcgtccaagagtgtggtggtgtgttcccagctgttagatgaaaatctaaaggatgaatactttgaggaaatcatggaagaatatgaagatattagacaggaccattatgagtctctcaaggagaggagatacttacccttaagtcaagccagaaaaagtggtttccaaatggattggctgtctgaacctcacccagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggcattaggttaacagaatcattagcaatggcacctgcttcagcagtctcaggcctctacttctccaatttgaagtccaaatattttgctgtggggaagatttccaaggatcaggttgaggattatgcattgaggaagaacatatctgtggctgaggttgagaaatggcttggacccattttgggatatgatacagactaactttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggttttttttttttgagacagagtctggctctgtcgcccaggctggagtgcaggggcgcaatctcggctcatagcaagctccgcctcctgggttcatgccattctcctgcctcagcctccagagtagctgggactacaggtgcccaccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagaccttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatgtattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaaaaaaaaat

SEQ ID NO: 296699 - DNA, 2973 bp, Homo sapiens
aagcacaaattgataatcatatgctcagatccatagcgctatgtatccaaatgctttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggtcgtttgatttcaaagcaagtcaacctgcttttttctgtttttacagtggaatctaggaggccacttagtcgtctttttttcctcttagaagaaaagcctgaaactgagttgaatagagaagtgtgaccctgtgacaaaatgatactgtgagaaatggggcattttaatctaagtggttataacagtggattctgacggggaaggtgtagctctgttctcttcggaagacctcgttttctaaaggctggactaaatggctgcagaactccctttggcaaaaggcatgcgctcactgcttgcttgtcagaaacactgaagccatttgccccagtgtggtcaagcagccatgctttctgggcattttcgtcctcccataatttcatatttccgtacccctgaggaaacaaaaaggaaatgaggagagaaagttactgttaagggtggttaacattttttttgttttgttttgttttggttttttttttttgagacagagtctggctctgtcgcccaggctggagtgcaggggcgcaatctcggctcatagcaagctccgcctcctgggttcatgccattctcctgcctcagcctccagagtagctgggactacaggtgcccaccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagaccttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatgtattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaaaaaaaaat

SEQ ID NO: 296700 - DNA, 2161 bp, Homo sapiens
tgactcagcgagcgccacggtatcttggattacagacgtgcgccaccatctctggctaatttttgtatttttagtagagacggggtttcgccatgttggccaggctagttctcaaactcccgacctcaggagatctacccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagaccttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatgtattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaagaaggtaactgataaaccaaaattgagcatagtaattacccacagaaggaggaagtggaagggacaggagcacataggtagatgccaagttatgcagctgttctggttcctcctggtaggcttacaagtgtttactatatgctattaatacattatactttataactaatagataacagttttttacatattaaatatgttctacttaaatatattataaaaaataaaggcaaagtggaatgataacctaaaaaaaaaaat

SEQ ID NO: 296701 - DNA, 1920 bp, Homo sapiens
ctctgggcccaagcagtcctcctgccttagccttccgagtagctgggactacgggcatgtgccaccatgcctggctaatttttcgtgttgttttggttagagacagggtctttctatgttgcacagactggtcttgaactcctggcctcaagcagtcctctcaccttggcttcccaaagtgctatgattacaagcgtgagccaccatgcctggctgatgtgttaccttatgttagcatatagctaccctgtgaagtagggttataatatatttgaatgaagagactgagactcagagagtttaagggacttgattaagttcttataaccttagcatgttaacattgtctgaattcaagtttcgtgtttatttattcataccacgtgcctttctgtgaaatccttacacctttttgcatctctaccttctaatgcagtgccttactcttagtaaatggtcaaaaggtagctgctgataatggtggtaatgaaagggcatgtttattctgggggcacaagaaactctaaagctcataattgacattataatctcttgttgcaggaatacttgctggctggggcagatatcattgaaacaaatacttttagcagcactagtattgcccaagctgactatggccttgaacacttggcctaccggatgaacatgtgctctgcaggagtggccagaaaagctgccgaggaggtaactctccagacaggaattaagaggtttgtggcaggggctctgggtccgactaataagacactctctgtgtccccatctgtggaaaggccggattataggaacatcacatttgatgagcttgttgaagcataccaagagcaggccaaaggacttctggatggcggggttgatatcttactcattgaaactatttttgatactgccaatgccaaggcagccttgtttgcactccaaaatctttttgaggagaaatatgctccccggcctatctttatttcagggacgatcgttgataaaagtgggcggactctttccggacagacaggagagggatttgtcatcagcgtgtctcatggagaaccactctgcattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggagagcgctgtaatgttgcaggatcaaggaagtttgctaaactcatcatggcaggaaactatgaagaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggtgagtggtttcttttggcctaatccattgtgtttcccaggttagatagtggtgggagaaaatgcaagtctgaaacagctacatatatacata

SEQ ID NO: 296702 - DNA, 281 bp, Homo sapiens
ttagcaatggcacctgcttcagcagtctcaggcctctacttctccaatttgaagtccaaatattttgctgtggggaagatttccaaggatcaggtaagctagctgttgcattatatgtggcttgcctagttcaaatgaaattctagaacctctctcattttaaatgtgaatgagaataaagtgaggggaaaggatgaagaaatttactccagttaatgtcttaatttgatttcaatagaatacctctattctagccctcacttctacatgcaagccacaca

SEQ ID NO: 296703 - DNA, 3402 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggatgttctataaaaatggcccagagtattttcaacaaagcgtgcttcatttgacacccagagtctgactttggattcgaactaaacccaggcaacaggcgaggcaggacagaggctgagtggaaaggtggtctggagccccttccctctccctgctgaccttggagtcgcaggcacccaccagctgccaagagaatccctggaccggctcttcctggatgggtccaagaattggacagctcagatggagtgagggcctattttccaacagctcttcgcagacccaagagcttggcacatttccgggttagggtggaatgggctttgcagggaagagggccccctgtgcacgcattccacagcctgtcggtcagaacttgctagttgcaggagacgggtgttacacgcagtcatcagacctcaccctcacagaggcacaaacccacatagttgtggacgcctgcagagactcaaatattgagaggacttctcctttttctctccctccagagctcccacgagctgatgcacccccaggcttcaaaccacctggaatgcacagctcagggaagctggtggatgcctagaggctgaaggacagggaactctccattattggggcaggactcagggaggacacttggggccatgtgtctggagagagggcataggttacaccctacagaataaagaagggacccaaagcctctttttgcctcccggaatcaaggccctgagggcagcaggatggtggcctgggtggggtcgtccaactaggtttgctaacctgaggggtcactgggcctggccacttctgtccctctggtggtggaacccagcacgtggttctgtagggacctttgtcagtgagcaagactgagatcgtcacaggagaaggtgcccttgctggctgccccagcaggcacccacctccctgccaggccaagccaggtgtcctcttgcagcttggccttgatgacctctgtttcttcctgggcaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaag

SEQ ID NO: 296704 - DNA, 3933 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296705 - DNA, 3391 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactcta

SEQ ID NO: 296706 - DNA, 3810 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcagcgtggctgcgtcctgtgggggcggtgtggactcctcccagttcagcgagtatgtgctttgccgggaggagcggcggccgc

SEQ ID NO: 296707 - DNA, 5061 bp, Homo sapiens
gggctggcggcgcgggggtgcccagcacaaaggcctggtgcaagagtggggttgcccacgtgggctggtcctggccgcgggtggaccctccccacgcgggcggtctcggagcttcctgccgcgcggtgtgtgtgtgtgtgtgtgtgtgtgtgtgtgtgcgcgcgcgcgcgcttgtggaggtccccgcactctggcccctgttctgggccgagcgccctgcagagctggcgagtttccggggtcagaaacgggctcacgcaactggggcttcgggatgcacaagtcccggcttggcgcccaaaatcagagaaagtctccagtgggacagatgtgcgtcctctgacgcccaccccacgagtccgaaacctggcaggaggggctgtcgcgctggtggtggtcccgggcgcgcagggtttggggctgggagaggggccgcgatgggagggatcgccgcctgcagatccggttccccgctgcccgcccgcaccccctgacctggacgcgcgcacccggcacacactcgcaaacacacccgggggcggacccccgcctctgcagcgcctttctgtcttccggcggcccccacccgcgactgcagaaagataagcttcaagttttcgctccgtatctcaaatgtgcatgaaggaatttaactgcacgagtgaataacagcattagtttcaattaatttttttttaatcccggcaacaataaactttgagaacaaaagcgcttttacgtccttaattaggcgagcttcccatctgtggtctccaagtgtctgcctcttgatttaactttgtccccgccccgcctccgcggcaacccctcccagcccagccccgcgcttcgggtgccgcggccaccccgccccgcggcgcctccagccttggcccaagccctctcccgtcgcccctaagttcacaccggccggctggctccgcggcggaggcgggagggggggggtggggaggctggcgcgcaccaggtggcccgcctgcctctccggggccacccctgggacaattgtgcaggcccccaggactttcgccccgggccagcgccctgagtgcggagccgaggggagctcgagaggcgccttctgtttaccttttatggttaaaataacagcttagcaaagaagcgacttcagaagaagcgatttagtgaaatcgtctcaagctgccgcagctcagccagtttaatcacccccagagagccgaacaactgcgagcgcaatgggacacaaaatcattttgtgtcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296708 - DNA, 4064 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcttagcaaagaagcgacttcagaagaagcgatttagtgaaatcgtctcaagctgccgcagctcagccagtttaatcacccccagagagccgaacaactgcgagcgcaatgggacacaaaatcattttgtgtcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296709 - DNA, 3849 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296710 - DNA, 3896 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296711 - DNA, 5170 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtgagggctgcacgctgccccctccccgccgcacccccggcgtccgcggagccctccaggggcagagtgagctggagggaggcgcgatccctgaaacggtgaagccccccgtgccatcctacaaaaaaggcaacaatgtgtcgatgcataatttatgtccctctcataattaaatgatggcgcctgggggatggacttaaaaaaatcgatctgtactttttttttttttttccaaaaggatgttctataaaaatggcccagagtattttcaacaaagcgtgcttcatttgacacccagagtctgactttggattcgaactaaacccaggcaacaggcgaggcaggacagaggctgagtggaaaggtggtctggagccccttccctctccctgctgaccttggagtcgcaggcacccaccagctgccaagagaatccctggaccggctcttcctggatgggtccaagaattggacagctcagatggagtgagggcctattttccaacagctcttcgcagacccaagagcttggcacatttccgggttagggtggaatgggctttgcagggaagagggccccctgtgcacgcattccacagcctgtcggtcagaacttgctagttgcaggagacgggtgttacacgcagtcatcagacctcaccctcacagaggcacaaacccacatagttgtggacgcctgcagagactcaaatattgagaggacttctcctttttctctccctccagagctcccacgagctgatgcacccccaggcttcaaaccacctggaatgcacagctcagggaagctggtggatgcctagaggctgaaggacagggaactctccattattggggcaggactcagggaggacacttggggccatgtgtctggagagagggcataggttacaccctacagaataaagaagggacccaaagcctctttttgcctcccggaatcaaggccctgagggcagcaggatggtggcctgggtggggtcgtccaactaggtttgctaacctgaggggtcactgggcctggccacttctgtccctctggtggtggaacccagcacgtggttctgtagggacctttgtcagtgagcaagactgagatcgtcacaggagaaggtgcccttgctggctgccccagcaggcacccacctccctgccaggccaagccaggtgtcctcttgcagcttggccttgatgacctctgtttcttcctgggcaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296712 - DNA, 2989 bp, Homo sapiens
  misc_feature (2)..(3): n is a, c, g, or t
gnnagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctacccagacgggactagatcctactgtaacagatcaatggcctcaattaatagcctttcattttccaagcctatgctaccatgaaccattacccccctaggcacagtagccctcagggaacagcaaccatgc

SEQ ID NO: 296713 - DNA, 1193 bp, Homo sapiens
tcatgcagccagcgtgacttggtgccccctggctggctgagccactgcctgccaccttctcataccattacgtgggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtctttttttttttttttaaagctactgcttgactgttccttagaataaataaaggatattttataaattaaaaaaaaagc

SEQ ID NO: 296714 - DNA, 1853 bp, Homo sapiens
cgttcctcggcgccgccggggccccagagggcagcggcagcaacagcagcagcagcagcagcgggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296715 - DNA, 885 bp, Homo sapiens
gcaggctggtacccccggggtacgggatgagcgctttccgggacgtggagacgcggagcgtcccgaggagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcatcctgggctccccatcccagggaggacctgacattgtcatcaatccaaccatggaatgtgccccgaaaaacgtacctacaaggacttctgtgccgttccgaagaaccaaaggtggacttggggcagcaagtgagttgtccaccccaaggtcagactccagaaggccattgaacactgctggaaccgggaatgttcaacccttgaagcg

SEQ ID NO: 296716 - DNA, 819 bp, Homo sapiens
  misc_feature (229)..(229): n is a, c, g, or t
  misc_feature (256)..(256): n is a, c, g, or t
ttcgcggtgccctcgctgcttctgtgtgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaaaaaaaaaaaaaaaanaaaaaaaaaaaaaaaaaaaaaaaaaanaaaaaaaaaaaaaaaaagaaagagggggggggcgcgcgcgcctaaaaatatattctccccggggggggcgcccaaatttagcgccgcgccccccctttttttttaacaagaagaggggcgccccctagagagggaggggttatataatatataaccgcgcgagcgggcggggggcgggggcttattaaaaacaaagggttgggaggagggagaaagaaatggctgcttcagtggggggtctattcttgggggggagagagcacaccccccattggtggggggggggggggcgaacaccatagtgggggcagcacaacatctctcctggaaagaagagattattaagaagcgtcgtcgggaggaggaaatatatataaaacaatttgcaggaggggtgtatataagagtgtgtgtgttagaccacacagccagcgtgaaatgttgtggaggggtcggtgtagaaaaaaagtttgtggtctacgcagcagagttgtatattttgctgggaaccaaattattttatcgacgacgagcgcttggttgatataaagaaagagactgtg

SEQ ID NO: 296717 - DNA, 328 bp, Homo sapiens
  misc_feature (29)..(29): n is a, c, g, or t
aagggcccacgtgtggggaggattcccanggaagtctctgctgagaggggatatgataaccacccagaagcaccagtgcttcttacctgtacttacccaagtggcaggctgtgtgccaactcctttatacacgttgtctcacctaaaccttagaatcccttttttatagctgaagaaactcaggcccacagaagcagcaagccaggtgtcacccagctgatgaatcaggagccaaggctgcccagactggtggcccaccgagtcctccagccccaaatgtctctgcctgtcaacaccttgcatcctccagccccacaagccattctaa

SEQ ID NO: 296718 - DNA, 1829 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296719 - DNA, 2449 bp, Homo sapiens
  misc_feature (9)..(9): n is a, c, g, or t
  misc_feature (15)..(15): n is a, c, g, or t
  misc_feature (1859)..(1859): n is a, c, g, or t
  misc_feature (1886)..(1886): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaaaaaaaaaaaaaaaanaaaaaaaaaaaaaaaaaaaaaaaaaanaaaaaaaaaaaaaaaaagaaagagggggggggcgcgcgcgcctaaaaatatattctccccggggggggcgcccaaatttagcgccgcgccccccctttttttttaacaagaagaggggcgccccctagagagggaggggttatataatatataaccgcgcgagcgggcggggggcgggggcttattaaaaacaaagggttgggaggagggagaaagaaatggctgcttcagtggggggtctattcttgggggggagagagcacaccccccattggtggggggggggggggcgaacaccatagtgggggcagcacaacatctctcctggaaagaagagattattaagaagcgtcgtcgggaggaggaaatatatataaaacaatttgcaggaggggtgtatataagagtgtgtgtgttagaccacacagccagcgtgaaatgttgtggaggggtcggtgtagaaaaaaagtttgtggtctacgcagcagagttgtatattttgctgggaaccaaattattttatcgacgacgagcgcttggttgatataaagaaagagactgtg

SEQ ID NO: 296720 - DNA, 2455 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgagaccctggctctgtctgtgttcgcgacgcccccgccctgccccgtgcggctctgaggacagacttgacttgggctttcaggggcctggtgcccttcactcccagctgcccagggctggggacggggctctggagagctccagactcctagaaagaagggggtcagttttccccttagtcactgtcctgtcctctcgctaatggcttcctgtctaactggctgggggtgattcggggtgactcaggagcaccctacacacccctggatcctctgaaatggcaaggggtaggcatgttggatgcgctggctacaagtaccagtgagagggagaggtcctgacagtcctgggtggtttttactcccctcatgtagcccaggacggggctgctgggggctgggaagggcctggggatatgagagccagggctacttgcctcacctcctgacactaccccagcttcagccgaaccctgcagcctggctccaagccagcccagcggcaggctcagcaggtcccaggggcgtggcagtggccagtagtagagccggcccacactggctaggcaggcagcacagtcccgcggacggctgagcgtgtggctgcaggagcttctgtgggagtacgg

SEQ ID NO: 296721 - DNA, 1839 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccattagtggactctgcatttaaaaataaataaataaataaaagaaaaa

SEQ ID NO: 296722 - DNA, 1786 bp, Homo sapiens
ccagctgtaccggccgagtttaggatgctcagggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296723 - DNA, 1880 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggaacagaactggcaaagaggcaagaggtcactgagggcctctgtcacccaggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296724 - DNA, 1772 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacaccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296725 - DNA, 2126 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttccaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgagaccctggctctgtctgtgttcgcgacgcccccgccctgccccgtgcggctctgaggacagacttgacttgggctttcaggggcctggtgcccttcactcccagctgcccagggctggggacggggctctggagagctccagactcctagaaagaagggggtcagttttccccttagtcactgtcctgtcctctcgctaatggcttcctgtctaactggctgggggtgattcggggtgactcaggagcaccctacacacccctggatcctctgaaatggcaaggggtaggcatgttggatgcgctggctacaagtaccagtgagagggagaggtcctgacagtcctgggtggtttttactcccctcatgtagcccaggacggggctgctgggggctgggaagggcctggggatatgagagccagggctacttgcctcacctcctgacactaccccagcttcagccgaaccctgcagcctggctccaagccagcccagcggcaggctcagcaggtcccaggggcgtggcagtggccagtagtagagccggcccacactggctaggcaggcagcacagtcccgcggacggctgagcgtgtggctgcaggagcttctgtgggagtacgg

SEQ ID NO: 296726 - DNA, 1511 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggaacagaactggcaaagaggcaagaggtcactgagggcctctgtcacccagactgcctctggctgccctctcccgcagactggtgtgaaatggcctgtgcccagcccgactgggagcccagcgggtggacatgggctggcctctttcttgtgagggccatatcagagcagggtctccaccacggccacagggggatcaagtcgccaaaaccaggggggaaaaaccaacacgaaagagaggcaaaaaaggggggaaagaagcacaaacacagataacacgcaagtca

SEQ ID NO: 296727 - DNA, 1674 bp, Homo sapiens
taggctaggtacgaggccgggggtgcgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296728 - DNA, 1723 bp, Homo sapiens
gcagtcgattccttagtctcaatggcagcatccctgaggagcagtgcgggccgaatcccctccctgtcaaagctgtcacttcgcgtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296729 - DNA, 2237 bp, Homo sapiens
gtgccagggagcctgggggagaagagccgagatcagggtggggcagggctttggccccaccaccccaggggcccagagagagatgaggcggccaggagtgccacctgcatgttttgggaggggtctgtgagtgcccccggccccaccgtgtgctctgggcctctatccctctgggacagccccgctgcccggatccctcaccctgggaccctcccctgccctgtccattctctcctgcccctcccctggctgccaccttcccagtatttgccccatggtgtgtccccagcatctgcacccccggacctgtcttgggttaaggagcctttcctgggaatgggggcgaagggttcagggccagtagaatggaaggggattgaggagaggggaagtcagtgagcggtcagtctcttcctctgtttgtaaagtcaccgaagggccgcctggctggtccccagctttctctctggagatcccaggcctccacagcaggaaggaaccagcattgtttatgatttgaccagagccagctcctgctctctcccctccctgccaaggcctgggtggggccaccaggcccggactccccctttgtaaggccacagcagcagcctctctccggtcccctcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296730 - DNA, 1855 bp, Homo sapiens
cgttcctcggcgccgccggggccccagagggcagcggcagcaacagcagcagcagcagcagcgggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgaggtgcgcgtactggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296731 - DNA, 1310 bp, Homo sapiens
  misc_feature (9)..(9): n is a, c, g, or t
  misc_feature (15)..(15): n is a, c, g, or t
  misc_feature (1115)..(1115): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggcgaggagccttcacttcgcatggagtggatgactactnagagggtgaggaatccacttcagggacagccgttcaggcggatggtggaggggctagacaaaaattttcgggccggggcaggtcgtcgggctctccgattgaataggtggccccgtcggacgcggagggcggcgtcatagccgagggacacacgatagaaacgattacgtttattgaggcggtgcgccgccccac

SEQ ID NO: 296732 - DNA, 1637 bp, Homo sapiens
acgccctggccgcttcgccatcgaggggaggctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296733 - DNA, 1633 bp, Homo sapiens
gataccagtgtcctcagatgtctgcagattaacacctgcatgatcactgttatctgtgttgggctgcaataacatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296734 - DNA, 1405 bp, Homo sapiens
ggaaggcaatacaaaatgtggcgagttgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296735 - DNA, 1878 bp, Homo sapiens
  misc_feature (9)..(9): n is a, c, g, or t
  misc_feature (15)..(15): n is a, c, g, or t
  misc_feature (630)..(630): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggccccggatttgccgnatccttgagcatgagccaacaccggggcctttttttcccccctggaaacgggggaggtttattgggtggggcttaaccggccggcctggggtacccgggggcccccatgagatcagtgctgaacgtccaagtggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296736 - DNA, 1712 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296737 - DNA, 1579 bp, Homo sapiens
gaccgggtactatggaaacatacgggaatagcccctgatttggattgggcctggagtggtgacctttgagctgagccatgaaggacaaatgggagttgggcagatggaaaggaaaggcatggtgttagggagtggcagagaggatgttaatgggcagaaagaccagtatgtgcagcgacatatagcaggtgagaaagggatgggcatgttcagaaaggtgcagggtagggcatagcacctgaggcggagcagttccacttagcctaagtggaactgctccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296738 - DNA, 1697 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296739 - DNA, 1159 bp, Homo sapiens
tgcggcgacctagaggatcccctcgcgaaacgtgatatcccaaggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296740 - DNA, 903 bp, Homo sapiens
ttccctgtgacccctgactcctgcccttccatagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 296741 - DNA, 832 bp, Homo sapiens
  misc_feature (9)..(9): n is a, c, g, or t
  misc_feature (15)..(15): n is a, c, g, or t
tctttcatnaagccncggtttatggtacgaggcctgggtggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctcatcttaacgacctagtgttctcggatcaacgcatgaccaggttactcaagaatacactgagc

SEQ ID NO: 296742 - DNA, 919 bp, Homo sapiens
cgttcctcggcgccgccggggccccagagggcagcggcagcaacagcagcagcagcagcagcgggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcaggccacagcagcagcctctctccggtcccctcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaaggtaggaggggctgcccactcctgaaaggaacggaccagttcccaggaagccctggagctacctctgagccagacactgacccccatgacacaggaattctaccctctgggccttgggctctgcaaggaagctgagcattgagccctcca

SEQ ID NO: 296743 - DNA, 390 bp, Homo sapiens
tggatcacaaggtcaagagttgagaccagcctggccaacatggtgaaacccggtctctactgtaaagaatacaaaaatgagctgggtgtggtggcacatgcctataatcccagctactcaggaggctgaggcaggagaattgcttgaacccaggaggcagaggttgcagtgagccgagatcgcaccactgcactccagcctggactacagagcaagactccatctcaaaaaaaaaaaaaaaaatgcccaaggctgcccagactggtggcccaccgagtcctccagccccaaatgtctctgcctgtcaacaccttgcatcctccagccccacaagccattctaatctccttctaggaacagaactggcaaagaggcaagaggtcactgagg

SEQ ID NO: 296744 - DNA, 217 bp, Homo sapiens
gccttgagcgccgagcttagcagctaggtctgattccagatttgtgatttcggcctggcccggattgccgatcctgagcatgaccacaccggcttcctgacggagtatgtggctacgcgctggtaccgggccccagagatcatgctgaactccaaggtaggaggggctgcccactcctgaaaggaacggaccagttcccaggaagccctggagctac

SEQ ID NO: 296745 - DNA, 1619 bp, Homo sapiens
ggcgcggagcgaggaagcgggtggcgctgggacgcatgctctgggggagatgagtataatgacccgcgtttgtccgccgcccgtgccccgctcaatccccgcatcaatcccgtgaggccgtttctcccgttggctccactgtaccgggggctgaggcccagggaggtctcgcggctccctaggttatccagctagtaagaggcgaagctggaattctcactgtgggcccattccatggcttttgccagagcgccagggacacactcagttcaccttctagcagggaagacccaaagatgcgcgcccctggcagccagggcgtcggaccaggcaattcctactgtccagcatcacctcctccaggcctctcggatgcctctgttgggacagctaagttcctcttcaaagactcaatttcctggtcataagctgtaaacagattctactcccgctttttcttctttgtcgcacgtctaccctatttgggaaagtttaaaccttagccaatcgggatcagctcagattgtgcggtccaaccccccagccaatggggaaaggacacagaaacaggaactgcgttagggttaaaaaccacttccctcctttgttggcgggtgctcttgggattgcaaccagcgcaagcagcacccttctgcagaagtaaagatgccttgctgggaagtcttctgtctcagtgctggtttttcttgactacactgagcacttgttttcaacaaatttgagggtcttctgggatcccattctcctttgggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaagccgccgacgggaccatcacaaaagctttacaaggccttaccaccctggcaaatgaattagccgaaaattctggactagataacccttttatgggtctcatggaaaagtggtttggaaaatggaaaggactcctggcttcaatctttacctctcttgcaattgtaacaagtgtacttatccttgtgggctgccgcatcataccttgtattcgtgggttaactcaaaggctcatagaaacagccctcactaaagccttcctctcttctctccctccatacttggacaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagtgcgcaagtagcaccgttctgaagtaaagatgccttgctgggaaatctgtctcagtg

SEQ ID NO: 296746 - DNA, 1332 bp, Homo sapiens
ggcgcggagcgaggaagcgggtggcgctgggacgcatgctctgggggagatgagtataatgacccgcgtttgtccgccgcccgtgccccgctcaatccccgcatcaatcccgtgaggccgtttctcccgttggctccactgtaccgggggctgaggcccagggaggtctcgcggctccctaggttatccagctagtaagaggcgaagctggaattctcactgtgggcccattccatggcttttgccagagcgccagggacacactcagttcaccttctagcagggaagacccaaagatgcgcgcccctggcagccagggcgtcggaccaggcaattcctactgtccagcatcacctcctccaggcctctcggatgcctctgttgggacagctaagttcctcttcaaagactcaatttcctggtcataagctgtaaacagattctactcccgctttttcttctttgtcgcacgtctaccctatttgggaaagtttaaaccttagccaatcgggatcagctcagattgtgcggtccaaccccccagccaatggggaaaggacacagaaacaggaactgcgttagggttaaaaaccacttccctcctttgttggcgggtgctcttgggattgcaaccagcgcaagcagcacccttctgcagaagtaaagatgccttgctgggaagtcttctgtctcagtgctggtttttcttgactacactgagcacttgttttcaacaaatttgagggtcttctgggatcccattctcctttgggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagtgcgcaagtagcaccgttctgaagtaaagatgccttgctgggaaatctgtctcagtg

SEQ ID NO: 296747 - DNA, 852 bp, Homo sapiens
  misc_feature (25)..(25): n is a, c, g, or t
  misc_feature (29)..(29): n is a, c, g, or t
  misc_feature (38)..(38): n is a, c, g, or t
ttcggagctggaaccacttgtgaanacanagtgcccanaaaaaaagtccagacattttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaa

SEQ ID NO: 296748 - DNA, 301 bp, Homo sapiens
  misc_feature (25)..(25): n is a, c, g, or t
  misc_feature (29)..(29): n is a, c, g, or t
  misc_feature (38)..(38): n is a, c, g, or t
ttcggagctggaaccacttgtgaanacanagtgcccanaaaaaaagtccagacattttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatc

SEQ ID NO: 296749 - DNA, 1683 bp, Homo sapiens
tctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaa

SEQ ID NO: 296750 - DNA, 1132 bp, Homo sapiens
tctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatc

SEQ ID NO: 296751 - DNA, 1091 bp, Homo sapiens
cgtaggctggagaagctatgtgaagaacagaagtgcccagaaaaaaaagtccagacattagagacggggtttcaccgtgttagccaagatggtctcgatctcctgacctcgtgatccacccgcctcgacctcccaaagtgctgggattacaggcgtgagccaccgcgcccggccgataaattcttattaagggaaagcaagtggcttcagcacatacagaaccaaaccctgaacacagaagatcaagtttcatgcaggaagatttgaacgctttgaccttttttaagaaatgtgtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaa

SEQ ID NO: 296752 - DNA, 540 bp, Homo sapiens
cgtaggctggagaagctatgtgaagaacagaagtgcccagaaaaaaaagtccagacattagagacggggtttcaccgtgttagccaagatggtctcgatctcctgacctcgtgatccacccgcctcgacctcccaaagtgctgggattacaggcgtgagccaccgcgcccggccgataaattcttattaagggaaagcaagtggcttcagcacatacagaaccaaaccctgaacacagaagatcaagtttcatgcaggaagatttgaacgctttgaccttttttaagaaatgtgtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatc

SEQ ID NO: 296753 - DNA, 4964 bp, Homo sapiens
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaa

SEQ ID NO: 296754 - DNA, 2737 bp, Homo sapiens
  misc_feature (2083)..(2083): n is a, c, g, or t
  misc_feature (2455)..(2455): n is a, c, g, or t
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaagtgagaaggccctttttcttctccctccttcctttcatagacttccttgcccacccctcctcttctcccttggcagctcttgatggcaccccttcctggggggctggtcatgaatgcctcatggattcagggcctggggcctgtgtgtaggtatggagtgtggatgctgctacccactccagcagcttaggagcacttcctgaccttctccccctgtcacctgagacacaagtgttaactctccaggccctggctcttggtaattctggttccccgtggaaatccaggttggagggatataagactttctgcaccttgggtaaaccaaggtacaagaactcaaggatgaagcaagatgggaggatgtgtggaggccactctccaatggctacatggaaatcccaccagaattcagacagtggcatgtgtgcctggaccagggctgggcaggcctcagtgggaagagcctccccttcttagcctacccccatctgacagccctcccgttcctcctgagtttgtgtgaccagagacctgctggcttatccggagcactttgtccttcctttgctcttcnggctggagcgagcttcagagctgttgccaagcagggtaccagggcctcagagccataggcctccttccagtccccaccccgtcccgggtctctaacaggtgctcaacctactccaccacactcccgagtgtcttggagggacagcatccttttttggcatttgtttgttgcgggtggggagaggattgaacccttaacctcacctcgctcgcaagtatcaagaaagggaacctgaccctaaacctaaaggtggccatacctggtttgtgaatgtattggagaggcatgcagcattacagtagaggggaagagaatgatgctaggtttgtgagtttcacccagtctggggagtctgtgaagcatatgtagtcnatacagacacactttttgtccctgcatgtctacagaatttctcctccttcaggccaggcccctcttctcccgccaccaccaaaatacaacccttaattaaaacaaacagcaaacaaaggacaccaaccacactccccagactaagccgagatagaaatggaagctagtgctttagggatattgtgttccataaattatcttgcctttttccactgttgttattatatcgtttcataacaaaattactttgaaccataaagttataaatacattttaaaagtc

SEQ ID NO: 296755 - DNA, 1902 bp, Homo sapiens
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaactctgaacctatcctcggagctctgccctcccgtcctggaacgtctttctgccctgaggagagggtagtcagcatctccaattttcagcagctcaagaaccttggcccccacaggacttcgcagatgtcacattgcccctcagtcccctgaatgcccttcggacccaaccccaattccccaagcccctgaccccctagctgccggggttcccactcccagtgccacaaccccctcacctccctggcagcccctcagcgagcctgaggcccagcacccgctggctccccagcacatggtcccctcccatgggctgttgcccagggaaccggggcgcggtgggaacgagctgctggcctcggcatgtttcaataaagttgctgtgctgggagctactc

SEQ ID NO: 296756 - DNA, 387 bp, Homo sapiens
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgccccgggacaacgctgggtacgcgtaacgcttgggcgccgtcgacagggatactctagcagcgggcgccctcggtcagtgatagtcacggacgttaagagggagaggagaaaggcagcccacaaacagtgcacctacgaagacaccagaagg

SEQ ID NO: 296757 - DNA, 5045 bp, Homo sapiens
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaagtgcctgggttgtgtgctcatttctggctgcctgaagtagtggagccggaagcccggggccctggcagagggagtgggttg

SEQ ID NO: 296758 - DNA, 4916 bp, Homo sapiens
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacaacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaa

SEQ ID NO: 296759 - DNA, 4555 bp, Homo sapiens
tgcattgtttcttgcttgcagaacatgcaggttgcttgtagaaacacacttacgtaaaaggagagagattctgggaagagtgggcctagcaggaatttggaaatttaggggtttctagttggctctacctgaagctgtgccttctcctctcccctgtattatcacatctcagatgaagcagtcttccttctcctgcctgaatgaacactattgaggttaggaccaataactgaagccgtatcttggatggaaaagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaa

SEQ ID NO: 296760 - DNA, 2754 bp, Homo sapiens
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaa

SEQ ID NO: 296761 - DNA, 2841 bp, Homo sapiens
  misc_feature (2768)..(2768): n is a, c, g, or t
  misc_feature (2774)..(2774): n is a, c, g, or t
cgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactagnctgggntgggccctgcaggggcagcagggagcccagctgctccccagtgacttccagtgtaacagttgtgtca

SEQ ID NO: 296762 - DNA, 154 bp, Homo sapiens
aaataataataaaagcctgccttgtgccttcacagattctgttgaccgaagagtttgtagagaaaatgttggaggatttagaagatttgacttctccagaggaagtaagcttgtttgacttttcctgacaacaggtcccgtctctgggaccatg

SEQ ID NO: 296763 - DNA, 2135 bp, Homo sapiens
  misc_feature (1537)..(1537): n is a, c, g, or t
  misc_feature (1898)..(1898): n is a, c, g, or t
  misc_feature (2027)..(2027): n is a, c, g, or t
  misc_feature (2051)..(2051): n is a, c, g, or t
  misc_feature (2083)..(2083): n is a, c, g, or t
  misc_feature (2089)..(2089): n is a, c, g, or t
  misc_feature (2108)..(2108): n is a, c, g, or t
ggctcgagagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcangccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcnaaaccagcctggccaacatagtgaaaccccctctctactaaaaatgcaaaaattagtccggcgtggtggcacactcctgtaatcccagctacttaggaggctgaggtgggagaatcacttggactccanaggtggaggttgcagtaagctganatcatgccactgcaccctagcttgggtggcanagcaanactctatcaaaaaaataantaataaatttgttcaaaagtcctgccg

SEQ ID NO: 296764 - DNA, 3249 bp, Homo sapiens
  misc_feature (18)..(18): n is a, c, g, or t
  misc_feature (272)..(272): n is a, c, g, or t
  misc_feature (378)..(378): n is a, c, g, or t
  misc_feature (397)..(397): n is a, c, g, or t
  misc_feature (725)..(725): n is a, c, g, or t
  misc_feature (2651)..(2651): n is a, c, g, or t
  misc_feature (3012)..(3012): n is a, c, g, or t
  misc_feature (3141)..(3141): n is a, c, g, or t
  misc_feature (3165)..(3165): n is a, c, g, or t
  misc_feature (3197)..(3197): n is a, c, g, or t
  misc_feature (3203)..(3203): n is a, c, g, or t
  misc_feature (3222)..(3222): n is a, c, g, or t
ctctggctgctgctccanctctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggtgagtcccctcagctggccaggacagtactctgctctcacctctctgcttcttgggctccatcccanctccccatcaactgatcttcttgcaaacccacagggctccaggacaccctccttctggagcccatgctgcctacagcacttcactccccaccagtgatgacaacanttgctgttctttgtccacnttatttacttgtttatctttaatgacaaaagttttttttttgttgttttttttttttttttgaaacggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagcnaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcangccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcnaaaccagcctggccaacatagtgaaaccccctctctactaaaaatgcaaaaattagtccggcgtggtggcacactcctgtaatcccagctacttaggaggctgaggtgggagaatcacttggactccanaggtggaggttgcagtaagctganatcatgccactgcaccctagcttgggtggcanagcaanactctatcaaaaaaataantaataaatttgttcaaaagtcctgccg

SEQ ID NO: 296765 - DNA, 380 bp, Homo sapiens
agtttgatgagtgtaacaaacaaatagagccctgagatacagagtaacactcggggcccacttccagagggtagcagggaaagacagtcagcaatcttcagcggaggcctgaagtctgagaaggccagtcccatgaagagtattccaggcaaaaaaaaaagacatatgtgaggcctgaaggtggttccctgctaagccaagtggccaaagtttgagttctttcatcatcatagtcatggaccaacatctcagcagtggggtcaaaatcatgatcctcagaagacaaagacccaactggaataaaacaaactgaatcactttacacatttacaaggctattaacaaaagaaaataaaaatttgtgttcttctgccaaaacc

SEQ ID NO: 296766 - DNA, 755 bp, Homo sapiens
ccactgcccggtggcagaacatccaggcatccgagtcagtggggagtgggaaaacggaggggtggagtagaagagagggaggaggttggggaaagaggggacccagtggtcttccgcggaggggaggggagctcttcccagccgagtcccctcctccttgctcttatcaggcaaacccacgttcctaggcgcggaagcaactttccttcaccttgaccaggctgaagccgtcgcatctaattgggactcttggcagaagcacggacctcctggcatcctctcctttgtcagtctttcctccctctctcgttcttttccctcccccaccctccctcttataagggtatatctgcagagtcttcagtgagccagggtacctagacgagaggatttttatacgaaaagccagggtagatttgccgactgctttgcctcactctgaaatccttaggcagtgcatgcaaaggtcggtgaatttcggagtggggtgaaggggcatggggcggtagggagggtggcggctccaactttaaagctctgctagagcgcttggctttcaggtaagcagggactaacagtccttacaagaactctcctgtggtccctgggcagggggctgaccgcatgccagaggagattaggagagcgggagcagagagggagtgtgagagccagggaggccggtacgcagctcagccgtactcgcgactcaactgcacactgcgagcccctggagagggtttgtgcagaacaat

SEQ ID NO: 296767 - DNA, 1130 bp, Homo sapiens
ccactgcccggtggcagaacatccaggcatccgagtcagtggggagtgggaaaacggaggggtggagtagaagagagggaggaggttggggaaagaggggacccagtggtcttccgcggaggggaggggagctcttcccagccgagtcccctcctccttgctcttatcaggcaaacccacgttcctaggcgcggaagcaactttccttcaccttgaccaggctgaagccgtcgcatctaattgggactcttggcagaagcacggacctcctggcatcctctcctttgtcagtctttcctccctctctcgttcttttccctcccccaccctccctcttataagggtatatctgcagagtcttcagtgagccagggtacctagacgagaggatttttatacgaaaagccagggtagatttgccgactgctttgcctcactctgaaatccttaggcagtgcatgcaaaggtcggtgaatttcggagtggggtgaaggggcatggggcggtagggagggtggcggctccaactttaaagctctgctagagcgcttggctttcagttacggaggctgggaagtacaagatcaagttgctggcagatctggtgtctgtagtaacaaattggaagcacttatgttagaactgaagagaaaatatggaaaaacttaaacatgcctccgctggtgataaccaggaaaacagggtctggagtagacctccagcaaactccaacagacctgcagctgagggacctgactgttagaaggaaaactaacaaacagaaagtaatagcatcaacatcaacaaaaaggacatccacaccaaaaccctatctgtaggtcaccatcatcaaagaccaaaggcagataaaaccacaaaggtggggagaaaccagagcagaaaagctgaaaattctgaaaaccagagtgccccttctcccctaaaggatcacagctcctcgccagcaacggaacaaagcaggacagagaatgactttgacgagctgacagaagtaggcttcagaaagtcggtaataacaaacttctctgagctaaaggaggatgtacaaacccattgcaaggaagttaaaaaccttgaaaaaagattagatgaatggctaactggaataa

SEQ ID NO: 296768 - DNA, 1812 bp, Homo sapiens
  misc_feature (856)..(856): n is a, c, g, or t
  misc_feature (879)..(879): n is a, c, g, or t
gaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaacccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcnggcagagcaggtgtggactaagncccctgaccttcacacctgctccccagagaagccccagccagttgcaccaagtagcagaggtgagtagaggggcctgggggcttccaaggccccaggtcatcctgttgaactgagagggacaggtagcccccctgcctgcgcccctggcccatgggcacctgagggcagtactgcatgggaagagcccaggatgcctcaggcctggcaactgtgacaagtatgaggaaggagagagaacgggaggggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaaa

SEQ ID NO: 296769 - DNA, 438 bp, Homo sapiens
aactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcact

SEQ ID NO: 296770 - DNA, 444 bp, Homo sapiens
aaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaaa

SEQ ID NO: 296771 - DNA, 2094 bp, Homo sapiens
  misc_feature (268)..(268): n is a, c, g, or t
  misc_feature (286)..(286): n is a, c, g, or t
  misc_feature (745)..(745): n is a, c, g, or t
  misc_feature (775)..(775): n is a, c, g, or t
  misc_feature (817)..(817): n is a, c, g, or t
  misc_feature (1556)..(1556): n is a, c, g, or t
gacccgcccgcccgcccctatgaccaacatgagctggagcttcctgacgcggctgctggaggagatccacaaccactccaccttcgtgggcaaggtgtggctcacggtgctggtggtcttccgcatcgtgctgacggctgtgggcggcgaggccatctactcggacgagcaggccaagttcacttgcaacacgcggcagccaggctgcgacaacgtctgctatgacgccttcgcgcccctgtcgcacgtgcgcttctgggtcttccanattgtggtcatctccacnccctcggtcatgtacctgggctacgccgtgcaccgcctggcccgtgcgtctgagcaggagcggcgccgcgccctccgccgccgcccggggccacgccgcgcgccccgagcgcacctgccgcccccgcacgccggctggcctgagcccgccgacctgggcgaggaggagcccatgctgggcctgggcgaggaggaggaggaggaggagacgggggcagccgagggcgccggcgaggaagcggaggaggcaggcgcggaggaggcgtgcactaaggcggtcggcgctgacggcaaggcggcagggaccccgggcccgaccgggcaacacgatgggcggaggcgcatccagcgggagggcctgatgcgcgtgtacgtggcccagctggtggccagggcagctttcgaggtggccttcctggtgggccagtacctgctgtacggcttcgaggtgcgaccgttntttccctgcagccgccagccctgcccgcangtggtggactgcttcgtgtcgcgccctactgaaaagacggtnttcctgctggttatgtacgtggtcagctgcctgtgcctgctgctcaacctctgtgagatggcccacctgggcttgggcagcgcgcaggacgcggtgcgcggccgccgcggccccccggcctccgcccccgcccccgcgccgcggcccccgccctgcgccttccctgcggcggccgctggcttggcctgcccgcccgactacagcctggtggtgcgggcggccgagcgcgctcgggcgcatgaccagaacctggcaaacctggccctgcaggcgctgcgcgacggggcagcggctggggaccgcgaccgggacagttcgccgtgcgtcggcctccctgcggcctcccgggggccccccagagcaggcgcccccgcgtcccggacgggcagtgctacctctgcgggcactgtcggggagcagggccggcccggcacccacgagcggccaggagccaagcccagggctggctccgagaagggcagtgccagcagcagggacgggaagaccaccgtgtggatctgagggcgctggcttgcgagctgggccagggaggaggagggttggggggctccggtggaaacctgcgaccccttctcctcagccttctccttagccggtggcctcaggcagactctgcccagaggggcagccaggctgctcagggaaggggctgaaagcggcagaggagtgccctggcttggtcaccactggggccaaggtggggtggagagaggcctangagccagaaagggccctctgctgtggtctgaaccccagggggagtggggcattgactccacccctgtcctgagctggaataggtcctctgggatgccagctctcccctttgtgcttccctgcagcaacccatggagggcccagggtgcctggtatgggcatcagttggtgggggtgcgggggtgcgtgtccccattccctgcaacagcaaatggggctccttcttcagccctccccttcccagccccaaactgagacagactgggagctgggagcctggggtggacaggaccataccctctttgagcttctgcgatgccggccttccgttcctctgggaggcttgaagttctgcagagatgttgatatgccttgcagcttggacccaatgggtggtggtcagggcctgggggcttggccatgctgggggaatggggctctgggttcctgcctgtggcctgtctgtcctcctccctaattcagacccagcctcaagaggaaagggagtaaaataaaactaacttgtttataaccttgtg

SEQ ID NO: 296772 - DNA, 544 bp, Homo sapiens
actttaaaccccgccaggattgattttggtaccctatgaaggctttgacgtccattcacgcgtcggtaacttggatctctaagagcgccggcctactactactaaattgcggccgcgtcgacgcaaagccattgtcatgagagtaaatgcctgccagttgttgaagataagatagatctcctcatttgatccacccccaaagcctgagatgcacgcattctggttctcctttaccagacaagcaaccgaggcctcagttcatgcatggccatcctgagatttgagagcccaggggctggatcatctgacttttcactgtatggtctgtcctggagcatattggtaaagggatgttgcctcccagctgcccacttcctcttggatgccctggtagccacacccttctctcacattagtaccacgttggaccagcctaatttgaagttttagtcttccagttcaaaataggaggcttagcgttaaggatttggcagacctctctgaagaagaggaatctgtcctgttctggtgacattgcgagccc

SEQ ID NO: 296773 - DNA, 715 bp, Homo sapiens
agcggggtcgttcgccctataggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagtaagtgtgagcatttgaaagaaaaattcagggtctgttaccattgactgcttttacttccatttaaagtattatttaataattcttaaatgtaaacttcttgttgacccattgtgcttattttggtggctgatttaaactttgtttggctttgatcaccctatgttaagagtagtattaatagcagcttcatggtactttgcatgcctgaatattctcccataatgttttcatctttcctgtgtagacacattgtatctaaacttagattttgccttaacttcttttgatcctataaacacataaaagccttgattaataaatcccccagaagccttcaaaccaagctggcttaggcgtggagtggttg

SEQ ID NO: 296774 - DNA, 624 bp, Homo sapiens
agcggggtcgttcgccctataggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaa

SEQ ID NO: 296775 - DNA, 357 bp, Homo sapiens
cctccaacacacacacacacacacacacacacacacacacacacacacactcacatctatcccttctgcaggttggtaacattggagctttgtaatttacctgccaagggactttgggaatttattccttggttcattcaaaataagtcaatttgactgagtgcatgccatatgcaaggctctggggaaactaagctgcttatgacctgagcttagagtccagtgaggaagcctggagtatgcatttgtcatggtggtaaaatcgtgcagtggcagcatggatgttgctatggaagcagaggaaggaatctcaataaggccaagggtgtcatggtcactgacaaattattgcataga

SEQ ID NO: 296776 - DNA, 783 bp, Homo sapiens
tgccaggctgggaggggctgccggcccctcggtgacttgcaccgggcccgcagtcaggctggggaggtgctgctggccccaccgctgagccgcctccctcaccgcacctctgctgcccctccaaaccagccaagatcagaccttgatctcacctgattaagcgcttgcttagtacagggcagaccctcgagacttatgctcaggtgatggccctaatggacgccttgatggacacgtccgggacccagggacccggagaccaggaatctgcaggtctcagggagccgcagaacctgaaacccaaaaataccaggcttgatcgcctgctcttcggtagtttaagaaccaggctttctttggcattgtatacctgccatgtgccaggctgtgtcgtgctctggggattcagtctctgtgcaaactatgactccatacagatgaagtccaagaacaggcaaaacgcatcacagaaggagcccctggagcccctggccgaacacatctgaaagcacggagccagacctctgcagcgccctccagcgggcaggttctgcgggcagccatctcctcgcaggccagaacacgccacgtcactccaggacggttcgccacctttgagaagagaggactccagtgtctgttcgctctggaaatgtgggcatgttcccattccaaaggtgataggatctgaggggaggatccttcccattttcaaagccttcctaaaatcccactgattagtggggaggagtgcaagtctaccctttccccgaaccacccaca

SEQ ID NO: 296777 - DNA, 392 bp, Homo sapiens
cagtgacagggatcatctataatgtaaatttttagacaagaagtgttggatttggttgttttaactagatactaccaaaagctatgtattaatctcaaagcactactgtctaaagcggggataaatgggtgataaaagggcttaagttgataggaagtaaccagtgatacaaatgcgcaggtagctaagagttgagaaaaaagatgtagctttctgtgggtggatcatcatgcatctgcttttttgggagaggtgggcagaatacctgtactgatgacagctaatctctgaatctttttcctccaggatgttccttcaggaggaagcagcactaaaagcactctgagtcaagatgagtgggaaaccatctcaataaacacattttggataaa

SEQ ID NO: 296778 - DNA, 380 bp, Homo sapiens
  misc_feature (3)..(3): n is a, c, g, or t
cgngccgcgcgacacggcgagaagacgacagaaggggtccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 296779 - DNA, 439 bp, Homo sapiens
  misc_feature (3)..(3): n is a, c, g, or t
cgngccgcgcgacacggcgagaagacgacagaaggggtccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaatctaaaaaaaacaaatatgtttataaaaaacatggcggcccgctggggccaatcgaatt

SEQ ID NO: 296780 - DNA, 226 bp, Homo sapiens
gcggccgcctactactactactactgctcgaattcaagcttctaacgatgtacggggacatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 296781 - DNA, 366 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 296782 - DNA, 599 bp, Homo sapiens
gcaggatttccgctttcgccctttccggcggtgacgacctacgcacacgagaacatgccttgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 296783 - DNA, 484 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaagactcaacaaaaaaaaacaacaaaaaaaaaaaaaaaaacttgtgttgggcgccgcccgtgggccccccggaaaaagttttttacaaaccacttccgttgggggcccgggggcccccca

SEQ ID NO: 296784 - DNA, 723 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaaaaaactaaaaaaaacaaacaatattaaaaactaatttttacaaacaacatttataattaaattgatcaaaattcacctaacttctttatacaacaattaaactgccaaaactctccctctacctaacttaattcaacttcccattacccaacttattccctttaactcaatcctatcttcccacaacctttaccttttcaaccccttctcaatccacatttccaatcaacacccctttccaaactttaatcccaactttaccctaaataattcttaaaaacccttatttttttccc

SEQ ID NO: 296785 - DNA, 1098 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaacccggggggctttttgggggggggggaaaaaggggctacgaaaggggcccaagggccaaacggtgttccctggacccagttttttggtccaaggggggaaatcggggggaccccctatagggagcgggatataactttccgagaaaagcccggggtaacccggggtttatgacttggcgtgaaaatactacccacaaccacacaaccaccgcgcgacccaccacacactcacccaacagagaacaaaacacatacaaaaacacaaaaaccacacaacacacaaaaacacaaaataaccaaaaataacactacaaaccacaacatactctaccacaccaacaaactaaatacaaaacaaaaacaaatttacttctttctatttattccatatccacaagaacagaggggggggagctcgtgtaagcaggcgagaggccgcagcgacgcgcaacggcgaggagcaggaggcggaggggtagaggagacgaaagcgacgcgagagcaggggagcagaagggcgggaagagaaagggagcgaggaaccggaaagagaaggcgcgagaggagggaaacgacggagggcagagaacgcgccgggaaggaggagggagaggggaagatgagggaaaagaagaagacgaagcacagaacgagacaaacggagggaggggaggagagggggtt

SEQ ID NO: 296786 - DNA, 487 bp, Homo sapiens
gcaggatttccgctttcgccctttccggcggtgacgacctacgcacacgagaacatgcctgacattaactccagggaccgcagcggcccacgggccacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 296787 - DNA, 720 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaacaaaaaaggaaaaaggaaaaaaaaaaaaaaaaaaaaaaaaccgaaaaaaaaaaaaaaaaaaaaaaaaaaaaaccttgtgggccgcttgggccaagtcgattttagatttgagcaagtttttgattggggccgaaaattgggctcattgggcaaattccccctatagggagtcgtttaacaattaatgggccggggtttaaacacgttgtgacttgggaaaaccttggggttaccaaaattaaaaggctttgaagatcccctttttcccaggttgcgtaataccaagcccccccgatggccttttcc

SEQ ID NO: 296788 - DNA, 886 bp, Homo sapiens
  misc_feature (370)..(370): n is a, c, g, or t
  misc_feature (375)..(375): n is a, c, g, or t
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaacanacacnaaataaagaagaacaaaaaaaaatgaagaacaaagaacaatcaaaaaacacataataaaagaaagaagaaaaagaacatagactaacgaacaaccagcatgcgcatcacaaacaaaactagaagaaaaaaacagagtggtgcggccccacagcacatgatgacacgacgcttccatccatagtagaagcggacaaggccgaccacatcagaaatgacatagcggaacgaaagatatgaacgaaccgacacggagaatccaggtggaaagaagagagggggtggactatcaaccaaagacagaaacacacggggcacagagatggggctccccgacaccaaacggacggcccgacggaaggaagactcaaaggggatcaacacgcaataacagggaccgaggcgatgttggatataaacaacaacccccggcggggtgggggagaaggcgcagaaacaaatcagacagccagatcagcaaactgactaggaaaacaaccaaataatgcgggc

SEQ ID NO: 296789 - DNA, 679 bp, Homo sapiens
gcaggatttccgctttcgccctttccggcggtgacgacctacgcacacgagaacatgccttgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccggtgtgtgacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 296790 - DNA, 1119 bp, Homo sapiens
  misc_feature (603)..(603): n is a, c, g, or t
  misc_feature (608)..(608): n is a, c, g, or t
gcaggatttccgctttcgccctttccggcggtgacgacctacgcacacgagaacatgccttgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaacanacacnaaataaagaagaacaaaaaaaaatgaagaacaaagaacaatcaaaaaacacataataaaagaaagaagaaaaagaacatagactaacgaacaaccagcatgcgcatcacaaacaaaactagaagaaaaaaacagagtggtgcggccccacagcacatgatgacacgacgcttccatccatagtagaagcggacaaggccgaccacatcagaaatgacatagcggaacgaaagatatgaacgaaccgacacggagaatccaggtggaaagaagagagggggtggactatcaaccaaagacagaaacacacggggcacagagatggggctccccgacaccaaacggacggcccgacggaaggaagactcaaaggggatcaacacgcaataacagggaccgaggcgatgttggatataaacaacaacccccggcggggtgggggagaaggcgcagaaacaaatcagacagccagatcagcaaactgactaggaaaacaaccaaataatgcgggc

SEQ ID NO: 296791 - DNA, 779 bp, Homo sapiens
gcaggatttccgctttcgccctttccggcggtgacgacctacgcacacgagaacatgcctgacattaactccagggaccgcagcggcccacgggccacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaggaagaaagacagaagatggaggagcaaaacctcgcgcgggcggagcaggctcgctggaagaagcttgtgtagaaccgatgatcggtggggcgggcggagggacccaggggacagtggtagacattgtgccagaggtgggccacgagggagattgcgggcccagaccgacgcggagggtacctcccagataaaaaaagcccgcgggtaacccgacggtcttgaccacatcaataggggccgagggccaagaggctagaacgagcccaaggagcgatacaatccccaccgg

SEQ ID NO: 296792 - DNA, 714 bp, Homo sapiens
  misc_feature (714)..(714): n is a, c, g, or t
gcaggatttccgctttcgccctttccggcggtgacgacctacgcacacgagaacatgccttgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccggtgtgtgacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactctttaccgtgaatctttaataccatttacatccaactcctacggttcttgtgttgggaaccagttatggtggatgagtgggcctaaggcacn

SEQ ID NO: 296793 - DNA, 374 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcactctgagtcaagatgagtgggaaaccatctcaataaacacattttggataaagactcaacaaaaaaaaacaacaaaaaaaaaaaaaaaaacttgtgttgggcgccgcccgtgggccccccggaaaaagttttttacaaaccacttccgttgggggcccgggggcccccca

SEQ ID NO: 296794 - DNA, 256 bp, Homo sapiens
gcaggatttccgctttcgccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcactctgagtcaagatgagtgggaaaccatctcaataaacacattttggataaa

SEQ ID NO: 296795 - DNA, 837 bp, Homo sapiens
cctttccggcggtgacgacctacgcacacgagaacatgccttgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccggtgtgtgacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactcttaaaatttgaatgtatgagactggcaaagttttgcatcttaggaggagtgattcatttcaccgtgatctctcatcacatttcacatacaacccctacgtttttttgtgttgggaaacaatgtaatggatgatgagttgggcataagtgcaggaaagacgggtgtaatagaggaaaaaaatgttatctgcttttctttcaggatgctataaaatcaccacggtctttagccat

SEQ ID NO: 296796 - DNA, 2997 bp, Homo sapiens
  misc_feature (494)..(494): n is a, c, g, or t
ttttgctgggattcattgaagggtctcctttcctcttcaattacatcagaatctaaagcagcaacagggtccccataaaaacttgctcttcgattgtcccagttcttgttgagtgctgctgtgaaaagtgacaggtttcagccatgggtcagcatttctttttaagacacctgatgatgctggtggaaatggatcagtgggtaacattgtgctgttctgtaaagggtgcagacctaagtcctccacttgcattctcaccttgtttggaaagccaatgatgttactaggtcaatggtttcattaaggtactcacccccatgaaggagcagcagtgtggtcccctgtcaatatttataaggcaccatgtcttaaaaatgtctgtttttagtatgaattagctttcattttccctattcagttctgcttttgggaacttgacagggcccatccatgagaatgggcttcacaaaatatggcaaatgtatgtaccaaantccttcgggaccactaaataaaggtgaaatgggcaatgtacaacaaatgttagtgtcacttctcagatatatattacacaatgattagtttgtttcttctccttggtcttttgtctttattagtggtgggtgatactttaataaaacctcatcacttgctggaaatagctgtaacttatcattctcatcctgtgcattagtggctagacataaacaagagggcccatttcagctgggagttttcatgtttcattgatgcgttttgctgacctatggatgaaacagagccatcactgagaagaaaaagcatggctgatagtgtccagtttttattaattaaatctttacagtagtcctcattgtctttggaatactattaattggcagctgcggctgtattgttatttgaaattggtcatcaaatttggattccacgttggaatctctagatatttctcgttagaaaattcttttgaagtagctgactctgcttcataactcacgcgctctgtaatggtgaaaagggagctgtgctgttttccaacatgatggcagtcatttcaaatggtttctaccaagtctttttttttttttttaattttgttgtttgttggaagttactaaccatgttgtaaacctgcccagttgctgcaaacttttacatttctctgctttacttaaaataatcgagctgtcagtcctttgttagaagtggtaaccatgcaagttcaactgtttaaattctgtaatgaattaagtgtccccccacctgttgcccttcccacccttccattttgtaatgaaaattccacttacagctgaaagagcagagaaatataaatgaagctcttggcttcaccaaattgcctgagattaacatgaagttttgcttctctgctcttttctccactgtaggtggttttttcattgacagcccctattgccagcctctgagcgtcgcaccatttattattcacttgggccctcaagatttcttctctgacttctagaaccatcaggttgtctggcttgaaatggcaatttctatgtcttggtcttaagagcaatgtgacaccctgaggctatccagctttcagacactccactctgacaccctctttttgaaagcaatgactgatcattttaaagaagagcaatactttgttcaaagccacggtgtctgttttaaaacttttcctttggaaacctagcaatatctgtacttaacccctttttagcatagtttcttgtcagggagtttacaggtcagtgtagagcttaaaattagcgtgtgagctgtgctatgttctgacagttttttacactttttagcacataaatagttacattcctgactgcgtcagttagcgttactataatttctcagagataggggtcctccttgaagccatatcctctgcacggggactggcccctagccagggatgtggcttgcagcttgtgtttcttcaggctgcaggagtaccccatctcttgtgcaaggtaattggtccagtagatttccaacatacctcatgctgactagatgaagtgcatgggtggtgaagtaaggagttgagtttatatagttctgaagtcgtttgtagtctctctcaaattgttagcctggggaacaaaccactgagagattttgctggtattggccttttcttttttttttttttttaattttgggtgaatgtttgaaaatcatgaatcagccaccattattaattgaagagctgggaatacctcgttaatgtatttttaaaactggtgttggaccctctgtgtatttcaggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatgaaaaaaaaaa

SEQ ID NO: 296797 - DNA, 857 bp, Homo sapiens
  misc_feature (857)..(857): n is a, c, g, or t
gtatgcggcaacgactctcttaattaccaccgctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagcccgagcggccgttcccttagaagggatattaatgan

SEQ ID NO: 296798 - DNA, 665 bp, Homo sapiens
gtatgcggcaacgactctcttaattaccaccgctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacag

SEQ ID NO: 296799 - DNA, 594 bp, Homo sapiens
  misc_feature (1)..(1): n is a, c, g, or t
  misc_feature (12)..(12): n is a, c, g, or t
  misc_feature (14)..(14): n is a, c, g, or t
  misc_feature (41)..(41): n is a, c, g, or t
  misc_feature (52)..(52): n is a, c, g, or t
  misc_feature (77)..(77): n is a, c, g, or t
  misc_feature (86)..(86): n is a, c, g, or t
  misc_feature (121)..(121): n is a, c, g, or t
  misc_feature (127)..(127): n is a, c, g, or t
ntttgcaccatncnagttttggggcggggggggggaatttnaacaggggggnttttgtgggggacagttgttctggnaaatagttncagggtatggaaaacccatatggttacagcacagntgcccntgcttatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacag

SEQ ID NO: 296800 - DNA, 2748 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacag

SEQ ID NO: 296801 - DNA, 3362 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgataaacaagaacaaaagaggcaagactgttcataaaaaattgagaatgttttagtttgcgatggacttcaaaacaaaatatttaccatgtactaacatataatttcatagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcac

SEQ ID NO: 296802 - DNA, 2885 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacag

SEQ ID NO: 296803 - DNA, 2763 bp, Homo sapiens
cgagtagctggaattacaggtgtgcgccaccacgcccagctaatttttgtatttttagtagagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacag

SEQ ID NO: 296804 - DNA, 3048 bp, Homo sapiens
  misc_feature (3048)..(3048): n is a, c, g, or t
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgataaacaagaacaaaagaggcaagactgttcataaaaaattgagaatgttttagtttgcgatggacttcaaaacaaaatatttaccatgtactaacatataatttcatagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagcccgagcggccgttcccttagaagggatattaatgan

SEQ ID NO: 296805 - DNA, 3232 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcac

SEQ ID NO: 296806 - DNA, 3346 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcac

SEQ ID NO: 296807 - DNA, 3128 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatgaaaaaaaaaa

SEQ ID NO: 296808 - DNA, 2842 bp, Homo sapiens
  misc_feature (678)..(678): n is a, c, g, or t
  misc_feature (689)..(689): n is a, c, g, or t
  misc_feature (834)..(834): n is a, c, g, or t
atgaggtttatgtggcaatggaggcaataggtttggagtcagtgatatgctcttagacacttttttctactcaggtgctacatgttatagaatcagccatctgcagggtgttgtcagagaagagagcatgagagtgtgtgtgtgcaagagtgtgtgtgtcagcatgccccaggctgggtgtgcatccacacagaagggaaaggcccttcctgtattgccagttttggcattagtcctctacatgagcctcagaccttcgcattgtgcattttctcttcatgcatctgctttgccatttttgtttggatgaaaattgtgttcctaaaacactgctaaactgaaccttcatctgatttcgtaactgtggacataagtagaaagtgaatagtttgaccactttgcccattaaaatagtttatatcctagaaagatgtgaagctacaagggtcacactttcggagcaaattttcttttaggcaaagtgcagagcctggagctacatcctttatatcctctggcacactcgggtgtggtcaaggcttccccatattttgaactgagccgtatgggtaactaggaattggagactaatgcaataataagcttacgcaggtttccttctaaattcaaactctctagttcctttgggtttgggtttggccatttgcttttaactantcagctggctnctgggtctcctgaccatctcatcctctctgtgacttaggtctggtccatttatccaagtacattttggctcactagactcactgtactatgtcttgtataagtgccaaaacatctgccgcttggggcagatatttaaatctgtgnctttcttttagacatacagtaagtttcagattcttcagtaaaggtttgctagagctcgatttttcctttgaaaatactttaatatctagattctaagttacattcatgtttttccttggtctttttttctctcttgttcctccctttcctcctttaacattatactttcaccctgtgccctctgagcccccacatcagaaagctcctctcttccacgtgccatataactgacttccaaagctggtgaaatttgatgcccccatttttcacataaaagatttggtttttaaatgttactgtgatgcaaacctactaaaacgatgctttattttggctgtaaggtaaatatgtcttttggcctttgtaaagctgttgcatgtggggtaatttccctctgatcatctggtgctcttgaatacctgctgttgctgctttgtgatttctccataggttaaatattagcataggaagaggagcagatttcaaatcatgctcgactatgcagaagtctgtgaggccacaagaacgtattaattacaaattcagaaagtaattaatctttccagatttgccatgccaatattggccatagccattaagaagttaagtaaacgcctggccatggctccagctggagctgaggtctgcatggaaagctatgctttgaaccttgacaacccgtttctcctggaatatgtgatatgccacattgagaaccaatatggatttctacagtcgattagaacatgattcaatagcattgcttttgattttcagaattcatggtagctcactcaatgaaattgcttcctagatgtagccatcctgattttgagagtggaaaatattatttatcaaaatattaagagcaatttcaaaatagatctgtgagcgatttatgggcctcttgcaaaatggtatacatgttgactgactgatctggaaaaggttaatgataattactgtcagatatttttttacctgaaatttttattggagtattaaaacttatttggagtcctctccgtttcttttctctgtaggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcac

SEQ ID NO: 296809 - DNA, 2818 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggttaatacttttaagcagttttcagcacgtttatctcactttattctcgttctcctcggaccttcgtagccatatcacttgtataaaataggctgagatatagtgactgtaagctgtgatctcagtatacaaagaaccaacttcagcaagactcgggtggtgaatatcgagtctgcagagaccaaatagacttaaagcaatccatctgtcttttccaggttaggtagctagattatttatttcccaccttattcaaccatcatggagttcatgtaaagatgtgagggttaggcagacattttaataaagatttgcttcatttaggtgtgtcccataaatgcatttaattgtgttagatgttgtgtgctaaggctgtatttgatatatgtaga

SEQ ID NO: 296810 - DNA, 1171 bp, Homo sapiens
gtatgcggcaacgactctcttaattaccaccgctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcac

SEQ ID NO: 296811 - DNA, 2491 bp, Homo sapiens
gtcacgtgctcgctgccgccgctgccgccgccgaagcggagaccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggtcagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggtatgagtaaacattaaacctttgcagaacctgtgaaaaatgttagaggaattaaattttctttcctgtccatgtggcactttagctttttctgaagttgtttccttttcttggacttggtgacctttgctttgggttaggtcacgaataatataaatttgattagtggtttcatgttctatggactttctaaacaaaatatatatgtacatgtatatttatatttatatgtat

SEQ ID NO: 296812 - DNA, 454 bp, Homo sapiens
ctatcttattgttattaaagtttgtccaagtttcatttggaacacctgccacttaattggtttctgtgtactacataaaatgaggggtgctttctagctcatagtgtggttgttggagtaattgagttaatttagatatgtgcctagtatagcttctatagttcatgatgttttattataattctttttggcttagtattctgaatttcagatggttgcttataaaatcaaacatgactgagaaaagctaaaggttaaattaggtagttgcctggagtggggttgccatgagactacgaaattaattttaatattatggtccttttatttttaaaatgtacctttttaagccttaattttactacttgtgattaattgattttttttgtttgcctgataactgatgaataatttgctacttagtattcacttgaaagaacttgcccaaaatgaa

SEQ ID NO: 296813 - DNA, 336 bp, Homo sapiens
tttgataatttgataggaatcgcttggtcaaattgtatttgtctctctttatcccattttactgttagaaaatgtttcgatgaaagatcctccggacttattggacaggcagaaatgcctgaacgccttggcgtctcttcgacatgccaaatggtttcaggttggctttttcttactatcttattgttattaaagtttgtccaagtttcatttggaacacctgccacttaattggtttctgtgtactacataaaatgaggggtgctttctagctcatagtgtggttgttggagtaattgagttaatttagatatgtgcctagtatagcttctatag

SEQ ID NO: 296814 - DNA, 1963 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaaaggcctgtgtgggttccaagttctgggagcagagtgtgcggctaggctcctgggatcgagggatgcagtacagccacagcatcaatcacaaacctcctgtaccatgtggtcggctggaaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtgcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296815 - DNA, 2071 bp, Homo sapiens
agaattacttgcaggagtaacctagtgcctatagctatggcaggtatcctgcatccttgttttttgtttagtggatcctctatccttcagagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacagtgaaataagatttcgccgcctatcatctgctaactgctacggactcaggctcagaaaggcctgcgcttcacccaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcaatcacaaacctcctgtaccatgtggtcggctggaaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtgcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296816 - DNA, 2030 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacgagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcaatcacaaacctcctgtaccatgtggtcggctggaaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtgcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296817 - DNA, 1996 bp, Homo sapiens
agaattacttgcaggagtaacctagtgcctatagctatggcaggtatcctgcatccttgttttttgtttagtggatcctctatccttcagagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcaatcacaaacctcctgtaccatgtggtcggctggaaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtgcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296818 - DNA, 1937 bp, Homo sapiens
gaggatttttgaaaccgtcttcagtctctccaaacagctgtgtccgttctccacatccttgtcagacctcacctctgcttgtgctccctccctcccaggtggtgcccctgcatccctaaaagcttcagtacagctcggtggtctgtgtctgcaatgccacatactgtgactcttgaccccccgacctttcctgccctaggtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcaatcacaaacctcctgtaccatgtggtcggctggaaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtgcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296819 - DNA, 2149 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatagactctggaacccctgtgctcttctcctcatctagtgaccctgaggtgatggagttttcaagtccttccagagaggtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcaatcacaaacctcctgtaccatgtggtcggctggaaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtgcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296820 - DNA, 1176 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacgagactctggaacccctgtgctcttctcctcatctagtgaccctgaggtgatggagttttcaagtccttccagagaggaatgtcccaagccttcgggtagggtaagcatcatggctggcagcctcacaggattgcttctacttcaggcagtgtcgtgggcatcagatgagtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcaatcacagtaagccaccccagtctcccttcctg

SEQ ID NO: 296821 - DNA, 1296 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccccttgccaacggtactcaccacaatgtccgcctactcatgtggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296822 - DNA, 962 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcaggcggaagccttaaagcagcagcgggtgtgcccaggcacccagatgattcctatggcaccagccaggaaaaatggcagctcttaaaggagaaaatgtttgagcccagtcag

SEQ ID NO: 296823 - DNA, 1158 bp, Homo sapiens
  misc_feature (82)..(82): n is a, c, g, or t
tgcttcttgacttccgcgcctagtgcgcagggccccattctccagtcccgcccacgcgcctttggaggctgcggtgggattngcttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcag

SEQ ID NO: 296824 - DNA, 313 bp, Homo sapiens
actgctacggactcaggctcagaaaggcctgcgcttcacccaggtgccagcctccacaggttccaacccaggagcccaagttccttttggccctgactcagacactattaggactggcaagtgataagcagagtcccatactctcctattgactcggactaccatatcttgatcatccttttctgtaggaatcggatataacatcatctgggtacccatggccagctgtgacttctccatccgcacctacacctatgcagacacccctgatgatttccagttgcacaacttcagcctcccagaggaagatacc

SEQ ID NO: 296825 - DNA, 1363 bp, Homo sapiens
ggttgtactggggagtcacagtgacagaaactgttttgtcagtttagcttatactctttaaattattaaaaaatataaacaagtctaccaaacaagtctgtccttcatgaaatatttagggaatatgtttcttatgctttgcaaaatgtatctcttacaataacctttaaacacccaatgtaagaagttttatttttcattaaaatgtaatctatttaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattcatcagcatggt

SEQ ID NO: 296826 - DNA, 1245 bp, Homo sapiens
tggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattcatcagcatggt

SEQ ID NO: 296827 - DNA, 1370 bp, Homo sapiens
ggttgtactggggagtcacagtgacagaaactgttttgtcagtttagcttatactctttaaattattaaaaaatataaacaagtctaccaaacaagtctgtccttcatgaaatatttagggaatatgtttcttatgctttgcaaaatgtatctcttacaataacctttaaacacccaatgtaagaagttttatttttcattaaaatgtaatctatttaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttcgcgaagggatatggtaatcccttccccccccaaaaaatccccccgaaaaacaccgggaagggaaaattttttattaacccccaaaaaaaaacaaccccctaccattcatttatttccattggctgtgttactggatgttttactggttgacgagaaactgggtcacaataaaaaaatggagatatgaaactcaaaattcatcagcatggt

SEQ ID NO: 296828 - DNA, 779 bp, Homo sapiens
  misc_feature (779)..(779): n is a, c, g, or t
ggttgtactggggagtcacagtgacagaaactgttttgtcagtttagcttatactctttaaattattaaaaaatataaacaagtctaccaaacaagtctgtccttcatgaaatatttagggaatatgtttcttatgctttgcaaaatgtatctcttacaataacctttaaacacccaatgtaagaagttttatttttcattaaaatgtaatctatttaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcacaacccgaagggatcctctan

SEQ ID NO: 296829 - DNA, 654 bp, Homo sapiens
tggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaaggtaactagaaataaagatttccacttggaagaggggcataagctagacaaggatgaagactcttacgatgatgaaatggcaatcctgacttgtttgaagttgataaccaggctctgaaatccaaactcaatggtgtaactctctcagtaagcaaggattttatatttagccaccgcgcccggcctcactcctagatcttaacccaactgaaacaaacgtatccttgcaagatctgtatgtaaatgtttaaataaaagatttatttatttttttaataacttaaaatagggatcttactgatatt

SEQ ID NO: 296830 - DNA, 462 bp, Homo sapiens
tcattctgtaatacatttcgtattatttattatcagagacagaatccttcaaccgaaaaagacgcaatgcagccatttatatgttgcttataatctgattatccttgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctggtaatgacttttgctaaagcctcttgagtctggagaaggggctttatttaaaggtggtgatgccatatcacacgtagatttctggtgaacagaagggtggtcatcagctgtcagtaaactcatctctctatacccttccatttgcttttcttaagtaatcatgagttggctgggcgcggtggctcacaactgtaatcgc

SEQ ID NO: 296831 - DNA, 289 bp, Homo sapiens
gtcactatagttttgcctattcttgaattacatagaaaagaaatgagtcagtatatagtctttgctgttgctcttacactttgcataatgcccttaagatgaattcatctgttgtttcttgtatcagtagtttgtttctttctatttattcatttaccagttgatggaccacttgggttgttcatgctctttgattatcataggtatttgccccaagagaaatgaaatatatgttaaggcaaaaattgttgcccaaatattcttagcaactttatccatgatgtcgacg

SEQ ID NO: 296832 - DNA, 440 bp, Homo sapiens
tatgaacctaccctcagcatgtgaagttggttatttagttattttgaaaattcaaatctgtatgctttagatatctcagatgtgatctaagctgtttctgttatttttattttttaattttatgatttttactgtctccaggtgtttctattcttttaacaacagagaaaaacaaaatcctttaccagtgggtacagtggttctcagttgggaggaggttgactttcccccacagaaaacatttggtaatgtctggagatgtttttggttgtcgcagctaggggagtgctactggcatctagtgggtggaggccagggattctgctaaatgttctgcaatgcacaagagtgtcccctgtaacaaaacattatccagccgagtgtcagtagtgctgaggttgagaaactgttcagtaggaggaagatcacaaaaaaaaaaa

SEQ ID NO: 296833 - DNA, 3512 bp, Homo sapiens
atttgaagtcctcgttccacgccttctcatcatcctgaacaccgagctctgggactccggcggagaatctaaacgtaaagcatcacccacggtcgtgaactgtaggctctcctggcatccgggatcttattctggccttggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcgaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttc

SEQ ID NO: 296834 - DNA, 2569 bp, Homo sapiens
atttgaagtcctcgttccacgccttctcatcatcctgaacaccgagctctgggactccggcggagaatctaaacgtaaagcatcacccacggtcgtgaactgtaggctctcctggcatccgggatcttattctggccttggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcgaatgttgtttttaaaggaattgacttacctgatgggatagcaccatctagtgccagtatcattaattctcagaatgaatatttaatacatttgttacag

SEQ ID NO: 296835 - DNA, 399 bp, Homo sapiens
ttttgaaagaggcaagtgtggtagtcagttgattattttcttggctgaactatagagaaatactaataatttatactttgcagattgaaagtctagaggaagaacgacttgatctgaaaaaaaaaaattcgtcaaatggctcaagaaagaggaaaaagaagtgcaacttcaggtatactcagttattctaaacctttaaaaagaattattgataagtgagttgtctggatatgaaattatttgtgtcttagctgtttttgctgttctattgtggatctgctacaaatttaataaatgacaataataacctgaaggagataagtgagtgtcagtgggttcagtcctgaatctgaaatagacaaaaacaaaacaaaacaaaataacaaaaaccaagcaaac

SEQ ID NO: 296836 - DNA, 612 bp, Homo sapiens
tcatattttctgtgcttaaaaagctccaaatcttggtttataatttcatttaggtttttgttaggatttccattaataattgtgataaaattttaacttgggttacagtttaaatatctggaaaattctttcacagaaagttacctcattcttcagtgatactggctaagtgaattataaccagttgcttgatggtatatgacatttttgcagcttatttgaatgtttttaagtttttaattatattgctttctattgtaggccttgaaccaaagacaatgattgatttaactgaatttagaaatagcaaacacttaaaacagcagcagtacagagctgaaaaccagattcttttgaaagaggcaagtgtggtagtcagttgattattttcttggctgaactatagagaaatactaataatttatactttgcagattgaaagtctagaggaagaacgacttgatctgaaaaaaaaaaattcgtcaaatggctcaagaaagaggaaaaagaagtgcaacttcaggtatactcagttattctaaacctttaaaaagaattattgataagtgagttgtctggatatgaaattatttgtgtcttagctgtttttgc

SEQ ID NO: 296837 - DNA, 1021 bp, Homo sapiens
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296838 - DNA, 1034 bp, Homo sapiens
aaaataggctaggtacgaggctgggtgtgtaattccctgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296839 - DNA, 1053 bp, Homo sapiens
  misc_feature (81)..(81): n is a, c, g, or t
  misc_feature (105)..(105): n is a, c, g, or t
  misc_feature (183)..(184): n is a, c, g, or t
  misc_feature (188)..(188): n is a, c, g, or t
  misc_feature (263)..(263): n is a, c, g, or t
tccagcagtctctttccctctctggcctttgtgctgcgcggtgtccaaatgttaagtagtcctgcccatgtcccgggctanatatacatcgaacccaagctgtanatgctcttgagtagaagcaactttaactagccttcgggggcaagtaatagagatggctttcggcagagttgggaaatnnactnaatgcattgtagggcctttccaacattgacatctgtggccattagtttgcagttcaaagcctcactgagccctcnaaccagctacagcgggccttgtaatccaagctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296840 - DNA, 958 bp, Homo sapiens
aaaataggctaggtacgaggctgggtgtgtaattccctgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296841 - DNA, 1190 bp, Homo sapiens
aaaataggctaggtacgaggctgggtgtgtaattccctgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcaggtaggtgcgtgcaccccgtccgcaccccgcccctgcagccgcctggtctccccgcctcccctcctccctgcaggtttgcgtggctgaggctcccacctcctgacctcgggggccgagagctttgcgagctgaccccgcttccttctggctttgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296842 - DNA, 855 bp, Homo sapiens
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttagggctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296843 - DNA, 1401 bp, Homo sapiens
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtaccacaaacagcaaaaaagggcgacaggatacaaagaatcacaaaggggcccaagatagcggtacccagaatactgtaccacgtgcccaaaaggactaggaataaaaccaggcgaggagcgaaaaaagcggaagcgcacacgagccggaacaggcaaggaccaaacagcgaggacccaagcgcaacacccacagactcagccggaacactaaataacaggaagcgaaaaaaaggcaatagaggagaaaagtgaagagtgatgtagaatatccggagagaagagaaaaaaaaggaaagacgaaaggaagaagaagcggcaagagaacacgagaacaaaccactcggcaaggagcacaaacacaccgcaacaccaaacaacaaga

SEQ ID NO: 296844 - DNA, 1042 bp, Homo sapiens
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagacgcctctttttcttcatcagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296845 - DNA, 1124 bp, Homo sapiens
aaaataggctaggtacgaggctgggtgtgtaattccctgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaaggtaaggctcgggagagcgggtgcccggcagttcgatgccgaccgccgacggcacagcaagtgtgtgcagacgcctctttttcttcatcagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296846 - DNA, 820 bp, Homo sapiens
gacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcagaacttggaccacgggaaggcctggggcatcctgaccttcaaagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccctgcccccacacccaactccgagggcccacgctggggaaagcgggaagcgctcgctccctttcccccattagtgctctctctgcctggatcccggcagaagctatgaaagggaataaagagaaaagaagtacc

SEQ ID NO: 296847 - DNA, 3239 bp, Homo sapiens
ggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaaaaaaaaatga

SEQ ID NO: 296848 - DNA, 3299 bp, Homo sapiens
ggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttctttgttttaccttgttttaaagaaaaagtgtttgcaggggaaagcattagatacaaggacattagtgccaattgtaatgaggggggtgtggagaagggcaggaggtgagctggggagacgcttctcaggggtgcaataggtggagagaggagaaaaccttgtgtgtggtgagctgctcaagattgtttcagcctattattctaacgctgtaattaaggaagcctgtggagggagtcttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaaaaaaaaatga

SEQ ID NO: 296849 - DNA, 2813 bp, Homo sapiens
ggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcgcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaaaaaaaaatga

SEQ ID NO: 296850 - DNA, 1917 bp, Homo sapiens
ggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaaaaaaaaatga

SEQ ID NO: 296851 - DNA, 2948 bp, Homo sapiens
ggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgtaacagtattgcacgtcttttattgttagagacacttgtccagcttcagatggtcatctggtgctctaggggagaataccagatggtggatttagctttgggttaaggggcgaggggtagaaattgaggggacactcgggcggacggttaacaaaacacgcgcggggcacaagtatattaaattctcgggtcacaatggcgacag

SEQ ID NO: 296852 - DNA, 1248 bp, Homo sapiens
gcggccgcgcgggggaggcgcgggatggcggcgggcggcgcagggtccccctctggcggtggcgcgatggtgcgcgccgcctggggagctgcggccgggggtttgaaccggccaacttctccagccggccggggcgagcgccagcgcggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgaaaaaaaaaaa

SEQ ID NO: 296853 - DNA, 423 bp, Homo sapiens
gcctactactactatactgctgcaagacgacgacagaagggtgagatataaaacaaaccaaaaaagaaaaatctatcacaaactatcattgccaacataccaaaaggaaaaaacacgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgaaaaaaaaaaa

SEQ ID NO: 296854 - DNA, 1894 bp, Homo sapiens
gcggccgcgcgggggaggcgcgggatggcggcgggcggcgcagggtccccctctggcggtggcgcgatggtgcgcgccgcctggggagctgcggccgggggtttgaaccggccaacttctccagccggccggggcgagcgccagcgcggcgtccggggcgagtgagtgcggggcgggggcagcggccgggcgcctgggccgccggtcgggccacctgctgcccggggaaggatagcgttgcgagagtgggacggggtgccccgggaacccctgatccacctagggcagagggcagcgagctacgggccggactcgggcactctggaggcgggcgagctcgggctgcctggggaggccgcaggcgatggcgtgtgcgcggctcgcggagcttcctagccgtgcgcccaccccctctgccttggaaggaaaggggattctaagcccaagatgccatcgccccccatcccgggcatgctttcattgctctttcctggcgggatcgagtactgtaacttctaggagccagatccccgccccaggaagcgcccctacttggagtcctcggaaactcttgccccacccgcttctgcgctgggcccccgggccggctgggaggggcggggccggctttccagagggaatctgcaaacttatcccgctgcacgccccagcctcgctggcttgctgtaaacaaggaacccgggggagtgcggagggagaaagagcttctcccaggcctcaccctactgcacacaccgacttccttcctcacgcctgtctctctttcctggttcccacccgtgccaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgaaaaaaaaaaa

SEQ ID NO: 296855 - DNA, 567 bp, Homo sapiens
tgggagggagcttggggggcctcactggtctttgggatacagggctcagaagctgtggaattgactgtactttctctgggtctgttttagcctgtggtagtcagagcatgtcacttactggaattcagttaggagagcatagattaaccttactcaggtaactttgattcagggctttattggggacgttgtttagatatttttaaaaattcacttttttagagaggagtggtttttaaaatgttctcattttggctttttctgtaactttttgaagtgtttctctatgtagatgttactttgttgtgaaattctgaaccatgacatttggcttgtttttgtttccaggagcttttgatgggaggccagcagactatttattcatgctcctctttaactggatttgcatcgtggtatccttcagtctgtgattttgggccagaaataaaccagttttgtttccaggtttggggaaatagaccatattctgtaaacgtttcaaattacaagtatttgcatcttggttgactaccgttaataagaataattatagttttttaaaaaaaa

SEQ ID NO: 296856 - DNA, 3254 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296857 - DNA, 6863 bp, Homo sapiens
  misc_feature (1739)..(1739): n is a, c, g, or t
  misc_feature (1896)..(1896): n is a, c, g, or t
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaagtgtttttgtcctgtctcatctaacattttactgcctgtgttcttagtgcatcctaatgagagctccatgaggagtatgatttacccctatgccccatctgctggagaaacctgaggcaacaagtgacttaccctagtcacacagtcacaggaagttagggattaaagcttaggctcagttgccttcctgttactcttttagccagggaccactgacaactagattccaacattacaggaggcatctcagctctctgagcctgctgagggacctgatgcaactccagagtgcgaaacagtaggctggtgaatgggcagagtcacaggttagtggggtgtcttttcttggcccatcagtttttacccatgattttgcccaaggaagggtaagttagcgtgttggtcagcaattttaaacatttttatattaaatactatggagtagacattttacaggactgttcagagttaaaatgagagacttgaggtttgtataggcccaaccccctgggagtttgtgctctttatctgcttttagggtttactgaagtgggctggtaagggcaacagctttgatttttgagacaaacttggatttgaatcccagtcccctcagatagcagtttttatactgggaaagttacttaatcaaacctccaagcttcagtttgcaagcctgtaaattgtgggagaagcccctgtctcacaggactgcatgagntaagatacactgttgggaagcacagtagcgggttctcggtaagtaaagctagctgccatattcctaaaggtgggggtaggagagcaggattttgacgatctgagaggagacgcgcacacacccagaagcatgtaatagtcgtgtgaccgttctgtcngtgaggcaaaaggctgtcgaagaacgggccagttaaatcaccatctgggtgtcacagcctgcctgacaatcatgcctaatctcatatcagggatatgcagtaatagcttgcatttgaaagctttaaaaaaacaaacaaaccaaacccttccacatcttgctaattttaatgttttgcagttctgtcattcctctaagggatcagtgagggcagtaaaacttgagcaggcctcctctttctccccttccttttatagggtaggggtatgtttttcaaagacttttcaaattgtgaactgtaatatacagagatataccatattggtggttgtggtgtgtgtgtttttctttaagagaataaaaagaaacttgtttctcttctgagccttgaattgccttcaggctaaaaaaacaaatgaccaatctggtttctaattatcaaaggacataataacagcaggtttggctttctgatctaggtttatcaagtaggatggcagatgcatcaattaaaaaaagcttggtgcttttggggggcagccaacagttactttactttaaatggccatattctaacttaacggcttgtagctacttctcagttgtgggcaacacaggatacaagattctagtggcaaaatcagcgagccctggagcctgccttccacttgaactttctctgttgggggaagtccttctgctaaattttgcataaagatcagatgacaaaatacagctccttgcaaaagcagtaactgctttgaaattaccataaatttttgttgattatgtataattgggtatctttttatactaattatttgcatttaatttcactatctacttaagcagtggagatggcttccatattgtcttagagtgagtagcaaagcaagacagccctagcattttctccagcaagtgttctattttattatgtactttggaggaatattattgtaccagaaggcatggatgttgagaaaccagcacttggaaaatacattttgatttaatggtaaagctgtatttgtttaaaatggaggaggtgagtataggaaggtataactgcttttctaaatggaatgctgatacatttgtatcaccattttccattccatttagagtagttatatcttctctgtacacactaaattttgtgtttaaaaggggtttttggccaggcgtggttgctcacgtcggtaatcccagcattttgggaggccgacgggtggatcacgaggtcaggagatcgagaccatcctggctaacatggtgaaaccctggctccactaaaaatacaaaaattagctggacatggtagcgggcgcctgttgtcccagctactcgggaggctgaggcaggagaattgcttgaacccgggaggtggaggttgcagtgagctgagatcatgctactgcactccagcctggtgacagagtgagactccgtctcaaaaaaaaacaaaaaaacaaaaacccgagttgttgtctgttttgggaagaggcatgaaggtatcgagtatgatgtaaacagactccagtcactgactgctgtcccttcccaggcaggatgcatgtagtataacaagtagtgcagggcgcaggctctggaaccaggctgactaggttggaatcctgtcactttcgaagcgcttcactcagtgttggctcaattttcttgtttataaaacaggagtaatagtaatgcctacctcatggggttattgtgaagatcagatgaatttataagcaggcagcacctagtgtaaggcaataatcactgagtaaattcacatagtaactgctctagtataaggtcaagtataaagcctgtcctcttcagggtttctgctgtggacaagtcacctgtcatgacttactcttgctgccaagaagggtttaagcggaggtatcagatcatgctctctgccttcaagcaaaattttaaacattaggatctgctaagtggaataggtttaaacacattctcagtttactaataaaagagtcaaagatgggaaatagttggaaaatactattgagagtgtaggcttgggtttaagttctcttagttgttctgtgaactcttagtttattaattttaaggtgggaaatcatctaaccgtctggggccccagctctcccaccatctgtgagaagggaagaatgtacctggaaggcagattctgaataaattttaaaacatacccatacttccaacatagaaagccttcttcccctgtctcctttgatgggctcagctgagagccttttagaaatgctgtgcaaggctcaaacatgcaggctgtggatttggcctttgaaagtgaatgtattttgtatcctttgatccagtttgagccatatttagatataccaagatgctatcagtcattctttggttgctgggcttgtgggtgtaatatttttgtttccatactgttctgcatggattacttttataagcagagaaaaaaacgttcagagtgtgaatttagctgaaatctgaatacatttaagaaacatgaaaaacgaatgccgtctgtggtcaggtcatggggctgagtacagaaaagacaaagttaaataagacgtccctcgctgccttcaacatgacaagtgccatgggaacagcaggagagggaggtgttctcggaggtcagataactatgtggaagtgactttgttctcttctctccgtttgtgtccccgtctttctgcaccaggtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296858 - DNA, 3200 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccatggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296859 - DNA, 3536 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcggttagattactcgagggggcattttgctccccgtttttggaaagggcctaagggggggttaaaaaaggaggggggtaacaaggcgcgggaacggtctggttgggaacctttgggggattgggccagattagaggagaaagtgtggacgttgcatgcttaaaaag

SEQ ID NO: 296860 - DNA, 3440 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttgagtga

SEQ ID NO: 296861 - DNA, 3201 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296862 - DNA, 2940 bp, Homo sapiens
tgggagggagcttggggggcctcactggtctttgggatacagggctcagaagctgtggaattgactgtactttctctgggtctgttttagcctgtggtagtcagagcatgtcacttactggaattcagttaggagagcatagattaaccttactcaggtaactttgattcagggctttattggggacgttgtttagatatttttaaaaattcacttttttagagaggagtggtttttaaaatgttctcattttggctttttctgtaactttttgaagtgtttctctatgtagatgttactttgttgtgaaattctgaaccatgacatttggcttgtttttgtttccaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296863 - DNA, 2812 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaatttta

SEQ ID NO: 296864 - DNA, 2885 bp, Homo sapiens
cggccgggcggtaaaatcggcgcttaccctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296865 - DNA, 2648 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccaaaaaaaaaaaaaaaaaaaaaagggggggggcggttagattactcgagggggcattttgctccccgtttttggaaagggcctaagggggggttaaaaaaggaggggggtaacaaggcgcgggaacggtctggttgggaacctttgggggattgggccagattagaggagaaagtgtggacgttgcatgcttaaaaag

SEQ ID NO: 296866 - DNA, 2796 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacagtggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296867 - DNA, 2137 bp, Homo sapiens
cgagctcggtacccatgcaagcttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296868 - DNA, 2619 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcatacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296869 - DNA, 2294 bp, Homo sapiens
tgagatggaatatcactcttgttgcccaggctggagtgcagtggcgcgatatcggctcactgcaacctccacctcccagttcaagcaattctcctgcctcagcgtcccaagtagctgggattacaggcatatgccaccatgcccagctaattttcctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgatgaggtgatcttctgcacgataaggtgatcttgctgcacgatgaggtgatcttctgcacgat

SEQ ID NO: 296870 - DNA, 1107 bp, Homo sapiens
tcatgtttccaattaatctgtgaggaaaggcgcagccttccccttcttccttggcccaacggttaaagaattcccattttttttttttaagacaggcctttaaattgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaa

SEQ ID NO: 296871 - DNA, 4800 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296872 - DNA, 5133 bp, Homo sapiens
agtgtttgtaatagtctacaaaggaacacctggtgacagacactcacccagcataagcagccaggagagtcacctagggtgactcctgggtgactccttggggaagcatgccctgaggtgcggaggcagaggatcttccatcccccgctgattgtgcacctggctcagctgccacctgctcaactgcggctcctgtctgtcagcacccctcttgcccctccttggcttggggctcctagaggcccaggtctcccatgggggccctctttggtgggaaggcctagggtgatgcccccacactcctcggcacaagtgccctagacatacccgactccagcagagccagagagcagcataaacacaggaggcatacacacgtgttagcacgttgcccgtgtgtgcaaatgggctaaccaggcttctgaagactcttactctggcggggagcccagactggtaccacagcccagaggggctgtttagacagctgtggaggccacaaaagagctccctgttgcttctcaggccctgccctgtggtgggtgtggagtctgtgtaggtctggtggggagacgggggtgttctggtcattcctgcccaataggcaacaccaggagggtggaagtggaccggccacatcattaaccctgtgcagcctgggcaggtggttttagggaaaccaagctgagggggttggggtgctgagcttgctggcaggaggaaggggtgctttgggtcttagaccccagcctgggggtgacagattctggccctgccttggcatcaggtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296873 - DNA, 841 bp, Homo sapiens
tcgttgacaacaggacacgacggacagggcaattcaacagaagacctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296874 - DNA, 948 bp, Homo sapiens
acggcttacgctacgagcgctggctgaaatcggacctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttggaattcgcggatgtgagttcccagaaattcctctccctccacacacgaacaaatttgttgggggcgctctgggccccagagaaaagttttaaacaccatctctgtggggccggcgggcc

SEQ ID NO: 296875 - DNA, 598 bp, Homo sapiens
gtgaggtgactctagaggattcgggcattctggactggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcgaggaccaaactactcaacatctccagtccggtcacgctcgatcct

SEQ ID NO: 296876 - DNA, 505 bp, Homo sapiens
gccaactggcagggtatccctgtggacggggggcttcctggatgcctacccgcccctgagtggctgctgttcccccagaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccggtgagggggggtcatcttgtccaggaccctgtcctcacacaccacctccaaactagcctacttgacttcatgggcaaccctgggagcacagcttcactggctttttctctggtccctgagcatatcc

SEQ ID NO: 296877 - DNA, 3856 bp, Homo sapiens
agagcaagatcactgtattttggaaagagttgattgacccaagactgattattgaatctccaagtaacacatcaagtacagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296878 - DNA, 3369 bp, Homo sapiens
gtgaggtgactctagaggattcgggcattctggactggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296879 - DNA, 4887 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcaggtgggggaggggctggccccgggggcggagctggggccctcaggatccccttgcccatctcacttcccagcctgttttactccacagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296880 - DNA, 5088 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttggaaaaaaaaaaaaaaaaaaggggggcctactggcggggacccccggggggtcccccagtgaactccccccggaggacttgggacgcagaggcggggcgtcgcaagagacgcgcgggctacataaggcgggccataccgttcctgggagcacccgtgaagcctacaccgacaggtagactaggcgggaaaggcacgcacagcgacgggggacacacttcgagaagcggacaccccatagttaccgaggggcgcaacataatggcccccaagggttagccacacgtcacaat

SEQ ID NO: 296881 - DNA, 4666 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296882 - DNA, 4841 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttggaggattgagtaaaacttcaataaattacaagtttttcaaaga

SEQ ID NO: 296883 - DNA, 2728 bp, Homo sapiens
atcgcctcattccttacgtcgttaatgtgcaatctcatttgggggctccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296884 - DNA, 3197 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296885 - DNA, 2677 bp, Homo sapiens
aactcgatgaagaacttggtgcggctggctgtcttcacaatggcctcgatgctctcaaactcaatgtaggcctggtctgaagtctttgagagccctttcttggagatgaactgggaggtaactcccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296886 - DNA, 4917 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttggaattcgcggatgtgagttcccagaaattcctctccctccacacacgaacaaatttgttgggggcgctctgggccccagagaaaagttttaaacaccatctctgtggggccggcgggcc

SEQ ID NO: 296887 - DNA, 2427 bp, Homo sapiens
attcctatcccctctccccaggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296888 - DNA, 2359 bp, Homo sapiens
gactctaggatccctctctgctccctcttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296889 - DNA, 4666 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgctcagggggcaggagtgggagtcgcaagatgctcagggggggaccagga

SEQ ID NO: 296890 - DNA, 4711 bp, Homo sapiens
  misc_feature (4706)..(4707): n is a, c, g, or t
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcacctttagtgagggttaattggggccccgaattaaccctcactaaaggccgaccagtttgtgagatttgactatctcttgtaggagtcagtggatatctgatcctttagtagggttaattgggggggatcctctagagtcganngcag

SEQ ID NO: 296891 - DNA, 4633 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggtggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296892 - DNA, 4574 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcacactccgatgtggtttcacccgagccaggaggcggccatcatgggaagttgggacatcccggccatttacaagggacccaacaagagttcgggcgcacaggagccccacagaaggccaggatagtctacttgagggcggcggtccagttattacagggtcctggccagaaagaaccaattcc

SEQ ID NO: 296893 - DNA, 4431 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcacacgcttcgtcgtaagggatcgtctagaacacagcaatt

SEQ ID NO: 296894 - DNA, 5226 bp, Homo sapiens
  misc_feature (4397)..(4397): n is a, c, g, or t
  misc_feature (4417)..(4417): n is a, c, g, or t
  misc_feature (4419)..(4419): n is a, c, g, or t
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccagcacctcctgcccacagtcaagtccatggatggctatgaatcctatggggagtgtgtggttgcactcnaatccatgatcggcagcacngnccaacagttcctgaccttcctatcccaccgtggcgaggagacaggcaatatcagaggctccatgaaggtgcgggtgcccacggagcgcctgggcacccgtgagcggctctacgagtggatcagcattgataaggattgaggcaggagacaaagagcaaagccccctctgtgtccctgagggacgccaggagcccaaggtcagggagccgcaagccagccttcacagagggcctcacttgcccgctctccaagaggttactatgaacgaacgcagagaaaacccgacgatcatacggggggaaggccctccagagggcccgacccgccggacccagctcccccgagggatgcgacgggcccatatgcacctcccacaagggatacgaatggcgccacgaccgggcagcgctacctggaccagcccgagccaatgggcggttgggccggcgtcccccaacacccaagtcaatagttcgtacgtcgaaccccttttgacgcattagccaccctgttcgataagactcaaagagattaccctggtgaaaacagagaggataccccagcagccaggagcctttatcttggcccaccacgcgaagtcaccgccccttcatcgccctgtccaagtggtgagccacacacatgcatatcacaacatcatatgtggcagctccatcaatcaaaatcgacacagtttgacacaactatgaacaatgataggccacttgacatacacgacgaacagcacttcggacgaacagccaccacgaagccaatcaacattagaatgaatgctgcagtagcaag

SEQ ID NO: 296895 - DNA, 1600 bp, Homo sapiens
gcccccttcaaggacgtagtaggcagtactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296896 - DNA, 5313 bp, Homo sapiens
  misc_feature (4484)..(4484): n is a, c, g, or t
  misc_feature (4504)..(4504): n is a, c, g, or t
  misc_feature (4506)..(4506): n is a, c, g, or t
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcaggtgggggaggggctggccccgggggcggagctggggccctcaggatccccttgcccatctcacttcccagcctgttttactccacagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccagcacctcctgcccacagtcaagtccatggatggctatgaatcctatggggagtgtgtggttgcactcnaatccatgatcggcagcacngnccaacagttcctgaccttcctatcccaccgtggcgaggagacaggcaatatcagaggctccatgaaggtgcgggtgcccacggagcgcctgggcacccgtgagcggctctacgagtggatcagcattgataaggattgaggcaggagacaaagagcaaagccccctctgtgtccctgagggacgccaggagcccaaggtcagggagccgcaagccagccttcacagagggcctcacttgcccgctctccaagaggttactatgaacgaacgcagagaaaacccgacgatcatacggggggaaggccctccagagggcccgacccgccggacccagctcccccgagggatgcgacgggcccatatgcacctcccacaagggatacgaatggcgccacgaccgggcagcgctacctggaccagcccgagccaatgggcggttgggccggcgtcccccaacacccaagtcaatagttcgtacgtcgaaccccttttgacgcattagccaccctgttcgataagactcaaagagattaccctggtgaaaacagagaggataccccagcagccaggagcctttatcttggcccaccacgcgaagtcaccgccccttcatcgccctgtccaagtggtgagccacacacatgcatatcacaacatcatatgtggcagctccatcaatcaaaatcgacacagtttgacacaactatgaacaatgataggccacttgacatacacgacgaacagcacttcggacgaacagccaccacgaagccaatcaacattagaatgaatgctgcagtagcaag

SEQ ID NO: 296897 - DNA, 1693 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggcccctcaccagccagcactttcctggggaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296898 - DNA, 3728 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296899 - DNA, 3516 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtgagctagggctgtgttgaatgtcatatgaaagggtacctgggggcatctggtcaaccccacttcatctctctcctgtgcatccctggcaggtcagggagccgcaagccagccttcacagaggcctcctgcccgctctccaggttatttgaagaaccagagaaaccgccaggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296900 - DNA, 3049 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatgtcatagccatccatggcagaaagagcaagagggcagggagggagcacaggggtggccagcgtagggtccagcacgtggggtggtaccccaggcctgggtcagacagggacatggcaggggacacaggacagaggggtccccagctgccacctcaccaacgaatacatttagtagcaggcacaggggcagctccggaacgattctcaggctatgcggagctcgaggcttgaaagcggagacaggcggctcggagttgagaggagtcccagaggga

SEQ ID NO: 296901 - DNA, 2772 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgcccgggacagggtcttgcaagcagcctcctgggcagtcgtaagggttgcggcgtgatgtcttcaataaattaagttttatttgga

SEQ ID NO: 296902 - DNA, 1229 bp, Homo sapiens
aaaaataggctaaggtcgaggctgccggttaatcggcagagggtaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggccccccacccaagaacagcttcaataaccctgcctactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 296903 - DNA, 2705 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgaaagggctctctcgtctgttggttctctctccacactggggaggtgatagcattgctttcgtgtaaattatgtaatgcaaaatttttttaatcttcgccttaatacttttttattttgttttattttgaatgatgagccttcgtgcccccccttcccccttttttgtcccccgacttgagatgtatgaaggcttttggtctcctgggagtgggtggaggcagccgggcttacctgtacctgacttgagcaccgtgtggagcctgtc

SEQ ID NO: 296904 - DNA, 1033 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagaggtgagacccccatcccatccactgaacaggagaccctttctcctctgagaactatttccctaccaaaggtggggaggccttctaagaccccaccagggacccccaccccacctcagcccagaggcagataacctgatccatcccgccctggttgccacaggtactatctcctctagggatggggcagaggtgctgggacaggtcagcaggacctctcgataacgcctcaggcttacgtacgcc

SEQ ID NO: 296905 - DNA, 620 bp, Homo sapiens
gttctcctccctttctcctcagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatgtgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttggaggattgagtaaaacttcaataaattacaagtttttcaaaga

SEQ ID NO: 296906 - DNA, 886 bp, Homo sapiens
ggcaagtggccgcctggagcccagggccgctgtccggggaagggggcgccggagcagcccggaattcctgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcaggtacttcccagtgtgcaggtcccctccctgcccctgtcccttggctctacctgcctcttcccatccccccttctcaaccccacctctcctgtaaccccctttcccttggccatgatgccggggccctttaaccctctttccatggaagtcactttacagctgcatcgtgcctcctactccactgagtgtgggaggcccaaacggctgcccactgacc

SEQ ID NO: 296907 - DNA, 346 bp, Homo sapiens
gggcagtggtgaccatgcactctctacccagattgccatgcaatcactgtggaatatcaaggtggcagtgctggtcaagccagagcacgagaaccgtatcagccatgtcagtacgtccagtgtgaagactggcatcgccaacaccctgggtaagtggggctggcaggtgcccaagagtggcagcgtctctctgtccatggcttctgcttcctctcaagcctaggattgccccatttttggtgatcttagtttccccatatatagggtactttgaactttgaaaaacatattcatattctaaatctctcccagcaccactgggaaggcaaggccaggataattaccc

SEQ ID NO: 296908 - DNA, 3543 bp, Homo sapiens
  misc_feature (22)..(22): n is a, c, g, or t
  misc_feature (82)..(83): n is a, c, g, or t
  misc_feature (2826)..(2826): n is a, c, g, or t
  misc_feature (2890)..(2890): n is a, c, g, or t
ctgactggtgctccctctcttncatcttgggctgtctgcatgtgtctcattcccccactctctcctgtgcctcccctctacnntaataatcaggtccaggtttctctgtactgggagaagacctgtggctggagcaggcagggatgcaccctatctgttccccattcctccaggtgggagggagaaggagtaacccactttattggccacagatgcaggggagaaaggagaaagcatgctgggagctggaaagagccctaagatcacctggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagatggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggccagccagttngtggggccaggccaggaccacacagtccccagactcagctggagtctacctgctggacagcctncgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagccccttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 296909 - DNA, 2844 bp, Homo sapiens
gcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggccacaccatggacccagactcaggcggtcagaggccgcggcagcagagccacggatggtgccctccgcccgatgcccacagccccacgccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagatggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatatatattaaaatatcggggtggggggtgattggaagggagggaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgc

SEQ ID NO: 296910 - DNA, 1826 bp, Homo sapiens
  misc_feature (1109)..(1109): n is a, c, g, or t
  misc_feature (1173)..(1173): n is a, c, g, or t
tctagaggatccctcggtgtctaatgatcggggtctcatggatcggggtcctcaggatcagcacccgtcaagacatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggccagccagttngtggggccaggccaggaccacacagtccccagactcagctggagtctacctgctggacagcctncgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagccccttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 296911 - DNA, 541 bp, Homo sapiens
gcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggcctcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 296912 - DNA, 771 bp, Homo sapiens
gcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtgagtgcagcgggaaccgggagggagcgggcaggcggccgggccaccccgcgacccctctgggacccgcggcactgcaactccgcagaagtgtccggggagcgggtctcgtcgagccggggggctgcccgcggacataggggcaacaaggctggggtgggattcttacctgtcctggaggcccggaccccttacctacggggcggcgtatggatgtgtggatgatgtggcctgcggggtcacccatgtgcaaagcaactttttcctgcaaggttctgggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattgtaagggctggccctga

SEQ ID NO: 296913 - DNA, 1347 bp, Homo sapiens
  misc_feature (630)..(630): n is a, c, g, or t
  misc_feature (694)..(694): n is a, c, g, or t
gcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggccagctgcctgtgcctgccatgggccagcctagcccttgtcccttttaatataaaagatatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggccagccagttngtggggccaggccaggaccacacagtccccagactcagctggagtctacctgctggacagcctncgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagccccttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 296914 - DNA, 296 bp, Homo sapiens
ggcatgtgtgagaatgactggatctgaggggcacctgtgtgtgcaggtgtgtgccaagcctgtgtgtatgtatgtacacacgcatagacgtgctctggggggcccacgtgttcacgtgtgttcctggcctgtgtggtgttagaggctggcagcccgagcccgctcccccagcccctgccacccccagctctaaccccttttcctcgtcttctcaggccacaccatggacccagactcaggcggtcagaggccgcggcagcagagccacggatggtgccctccgcccgatgcccaca

SEQ ID NO: 296915 - DNA, 2996 bp, Homo sapiens
ctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaata

SEQ ID NO: 296916 - DNA, 3029 bp, Homo sapiens
ctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaata

SEQ ID NO: 296917 - DNA, 2859 bp, Homo sapiens
cgggccagcgcgagcgcggagcaccggcacgtcgggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaata

SEQ ID NO: 296918 - DNA, 1879 bp, Homo sapiens
gttcggtaatatttttcttgtatgaattctaataattaaactgtttttcccttagcttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaata

SEQ ID NO: 296919 - DNA, 3383 bp, Homo sapiens
ctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaataaaaaacaataaaaaacaaaaaataaaaaaaaacaagaaacacaaaacaacaaaaaaaaaaaacaaaaaacaaaaacacaaaaacagaacaaacaaaaaaaaaagagtcggggaggccgacgacccccacccacaagaagtaattgaccaaacaaccaacaacgataaaaaaacgagaggcccgacgtactgatatggtactagaagaagtatatatagcatcacacctgggagggggcggtcgcaccaaataaggagtagaccccccaaacaaaaaaatcgcgcggagccagcgtatgtgaaggagcactcagcaaaaatacgcaacggggacaatgatatccacgacgattatatcacgcgtgtaaataaagacggcgattatcgg

SEQ ID NO: 296920 - DNA, 2942 bp, Homo sapiens
ctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaatactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaata

SEQ ID NO: 296921 - DNA, 2269 bp, Homo sapiens
ctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaactacctaaaattctattgtatgcgatattttcggagtgtattttttgtcgaattttcacaaaaatattaacaaagttattcg

SEQ ID NO: 296922 - DNA, 420 bp, Homo sapiens
tatctcagttaaaatgatagtttagtgcccatgagctgtcaggtggaaaagggcctctgttgtggaagacggcagggcagggccctctgcggctaatagagaagctgtggtcacagcaggaagcagttcttctgtacagggcttggttcaggttgcagccaactatctttactgctcttgtgcaaagcctcagacaggtttttttgcttagcatcatccattgtaatgttcccctcactaattaatccagaattgatggtataagtatgtaataaaggctttaatatatcagttaactgtgttgcctgttttatactgtaggaaaaccactgctggaatgtaaaataatattgtcttttagtatctagcagataggaggtactgtgtcacacagctgttggaagaattaatagtgaagta

SEQ ID NO: 296923 - DNA, 3073 bp, Homo sapiens
agagtgggtgcagtgtctaatgcctgtaatcgcagcactttgggaggctaaggcaggaggatcacttgagctcaggtaaaagagaccagcctgggcaacaaagtgagacctcatccccacaaaaagttgtttagaaaattagctgggcgtggtgatgcatgcctgtggtcccagctacatgggaggctgaggcagaaggatcacttgagcccaaggaggttgaggctacagtgagctgtaatcatgccactgcactccagccttggggacagagtgagaccctgcctcaatcaatcaatcaatcaataacaaaaacttaaatagctattaacctcagtcttctttccttcatataaattctattctaagaccaaatagaaaaataaatgtaactaactttgcagagctattgacattgagagacctaacaacagactgcaatggggattgtaaaataacttttcagccttgcacttgctcatatatgttttgagaaaaatgtaagttaggtataacttattgtttaaactattataaggcagtgtttacataaataaatcatctctttcttggaaaacattgagacaaatttattttcagttttacttaaacatgaaacctgtattttagtgctttttgttttgtccagaaatttccagattttgtcttcattttttttcctggttaaaatctaaaccatagtgaagatagtatttatgtttacattttatctgtgaatgtggctaagcagagaagctacatggctttggtctacatattttttgaccttgtatttggttctgtagttgcagacttgtgaaggcttacatcatcatggagactttagtaaggaaggaaccaaaaggtttttggtttggggatgcaaactggaggttatgttacaagtcttcaatgcattttctgtgttcctggcagcagtgttgcctttttttttcttttccttttttttttttaaagaccaggtagggtagtgttattgaagggtaattgaagagtggtagagagtaagaggttttgaaggaggcaggtttgctgttatcacaaaataatttgggggaaacctttcgtggctgtgctgcaagaattctttatgtggctatcctctccatagttttctgaccagaattgcaagggcaaaaatagaacttctagctctatttatttgtatcctttgaaatcagaacttatccttagaaccagtcagttaaataatgcggactatgcctataatcccagcactttaggaggctgaggcaggcagatcacgaggtcaggagttcgaggccagcctggccaatgtggtgaaactccgtctctactaaaaatacaaaaattagccgggcgtggtggtgcacgcccatgcctgtagtcccagctactcgggaggctgaggcagaagaatcgcttgaacccaggaggcggaggttgcagtgagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagaggaaccagattgttttatagctgataagaaacagtctgttttagaaacatctgtttggaaagtattactcatgtattcacaaagtcatatttataacactagtcttctttgactgtattcaacaaaaggcagtttcaccattaatttcatagtaagcttttttaaaggattctagatctaaattgcctaagaatgttaaccacattcttgttttaaactctctaatttaataaatgtaattattttatagtcttttatagacttacattttcttcatactaaaggtaatgataatatagtcatttgccagtactttaaggtattcaggcatttgagacaagaaagctgtcttgtagaatagtccaattgctttcttaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggaaaaagtttc

SEQ ID NO: 296924 - DNA, 1844 bp, Homo sapiens
agagtgggtgcagtgtctaatgcctgtaatcgcagcactttgggaggctaaggcaggaggatcacttgagctcaggtaaaagagaccagcctgggcaacaaagtgagacctcatccccacaaaaagttgtttagaaaattagctgggcgtggtgatgcatgcctgtggtcccagctacatgggaggctgaggcagaaggatcacttgagcccaaggaggttgaggagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagaggaaccagattgttttatagctgataagaaacagtctgttttagaaacatctgtttggaaagtattactcatgtattcacaaagtcatatttataacactagtcttctttgactgtattcaacaaaaggcagtttcaccattaatttcatagtaagcttttttaaaggattctagatctaaattgcctaagaatgttaaccacattcttgttttaaactctctaatttaataaatgtaattattttatagtcttttatagacttacattttcttcatactaaaggtaatgataatatagtcatttgccagtactttaaggtattcaggcatttgagacaagaaagctgtcttgtagaatagtccaattgctttcttaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggaaaaagtttc

SEQ ID NO: 296925 - DNA, 2690 bp, Homo sapiens
agagtgggtgcagtgtctaatgcctgtaatcgcagcactttgggaggctaaggcaggaggatcacttgagctcaggtaaaagagaccagcctgggcaacaaagtgagacctcatccccacaaaaagttgtttagaaaattagctgggcgtggtgatgcatgcctgtggtcccagctacatgggaggctgaggcagaaggatcacttgagcccaaggaggttgaggctacagtgagctgtaatcatgccactgcactccagccttggggacagagtgagaccctgcctcaatcaatcaatcaatcaataacaaaaacttaaatagctattaacctcagtcttctttccttcatataaattctattctaagaccaaatagaaaaataaatgtaactaactttgcagagctattgacattgagagacctaacaacagactgcaatggggattgtaaaataacttttcagccttgcacttgctcatatatgttttgagaaaaatgtaagttaggtataacttattgtttaaactattataaggcagtgtttacataaataaatcatctctttcttggaaaacattgagacaaatttattttcagttttacttaaacatgaaacctgtattttagtgctttttgttttgtccagaaatttccagattttgtcttcattttttttcctggttaaaatctaaaccatagtgaagatagtatttatgtttacattttatctgtgaatgtggctaagcagagaagctacatggctttggtctacatattttttgaccttgtatttggttctgtagttgcagacttgtgaaggcttacatcatcatggagactttagtaaggaaggaaccaaaaggtttttggtttggggatgcaaactggaggttatgttacaagtcttcaatgcattttctgtgttcctggcagcagtgttgcctttttttttcttttccttttttttttttaaagaccaggtagggtagtgttattgaagggtaattgaagagtggtagagagtaagaggttttgaaggaggcaggtttgctgttatcacaaaataatttgggggaaacctttcgtggctgtgctgcaagaattctttatgtggctatcctctccatagttttctgaccagaattgcaagggcaaaaatagaacttctagctctatttatttgtatcctttgaaatcagaacttatccttagaaccagtcagttaaataatgcggactatgcctataatcccagcactttaggaggctgaggcaggcagatcacgaggtcaggagttcgaggccagcctggccaatgtggtgaaactccgtctctactaaaaatacaaaaattagccgggcgtggtggtgcacgcccatgcctgtagtcccagctactcgggaggctgaggcagaagaatcgcttgaacccaggaggcggaggttgcagtgagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggaaaaagtttc

SEQ ID NO: 296926 - DNA, 5237 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatggaaaaaaaaaaactt

SEQ ID NO: 296927 - DNA, 2385 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacggagcattcaccgctgacccctcaccgtcgggacctctgtagccgctctatctggctagcaaggaagattcgttcagacctgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtagcagttagtcccttctctcttccttgctttctcttctaatggaat

SEQ ID NO: 296928 - DNA, 5145 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296929 - DNA, 5093 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaaacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296930 - DNA, 4432 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296931 - DNA, 5693 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaaggcatgtctcagattttactgcagacatgttaatgaaatataagtaggaaagcactgttgcatgcttttattttatctgttgccaagctaatgggtatagaattaattttaaatgagtaattattatgcacttcttttgtaagtctaacaccttaatataccctgataataatcctctttcccatttgtagaactttattttgattatatacaagtttttatgagtctgcatgttttatttcaacaaggtatcatgaattgcctgaatacttagaattttttaactaattgtctcgtttctctttacaattatagtgaaatttgatttacaggcatctttagtctggggagggttcattccatgagcaacatatacatatatttggatcattactatgcatgtgaggatgattggtaggaaatcacatttcatgaactgaggaaggtagttttataacaaatcagtgataactctaagctttaatttgttgtcatagtcttccttgaaaagatcttttgtctagtattgaaatgcatttgtgttttcagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296932 - DNA, 5091 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactatagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296933 - DNA, 6063 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaagaagagagagcgagagaggagactatagctactaatcacagcaagagcacagacacagagaatacacacagcaaaaaaaaaagacgatgagagagagagagagataagaacaagacaagaaaccaaggaaaaaaagaagacagaggcgagcggagaaagaagaaaggaaaaaaaagagagaggaagagaagagagggagacgaagaaagaaaaaagtatcgagccacacagggacaacaaaacaaaaaaagatagtggagacggagagaagacgaaacacacggaagaagagcaacaaacgaagaggatgaaaaggaaaagaaaacaaaacacgatgatcaagaaataaaaacaagaatatcagaacaagataaacggacagaagaaaggaagagacacgaagacaagaacaaagaatgcgaaagaaacgagaaacagaaaagagaaggcaaagaagaccaaacgaagagagaaccaagatagggggcagcaatgagaaaagaaatagaacaaagaagaagagcgagaagggagcaagaaaaccagaaacaacgaaaggaggaaacggagagactgaggaggaagggagagaaaaaaaagagaagaagggaaagacaatagaaagcaagagagaaaaagacaggtcgagaagacagaagcacagacgaagagaacaaagcagagataaaggaagagagaggacaggacgatcgatcaacgaagtgagcgcgaagagacagcaaagacaccaagagcaaagcagcgaacgcacacagcagacaggacggagcccgcgacaccgagcaaagcacacaa

SEQ ID NO: 296934 - DNA, 4740 bp, Homo sapiens
agcattttagcttggcaaacttgtttcatcagtatctgggcctggtactatgctgaactaggtggtagaaagaaaaatgagacatggccctcatcttcaaggaccttggggtatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296935 - DNA, 4780 bp, Homo sapiens
agcattttagcttggcaaacttgtttcatcagtatctgggcctggtactatgctgaactaggtggtagaaagaaaaatgagacatggccctcatcttcaaggaccttggggtgtaaggcaaagatgcattaattagtggagatatgtcaaatatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296936 - DNA, 5143 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggcccctccccccaatccttaaatctttaaggcgaagtgggcaccccacccttcatcaggagtttcagtgttgcagggaattatagaccgacgtccaaacggccgcctcaccctctccgcacacatctggcagtctttttggactttttggtccagaa

SEQ ID NO: 296937 - DNA, 4985 bp, Homo sapiens
taccacttaaaaaattaccaaataaaatcccctcagacatgttcgctacaaccagaatgtctcatttctatttacttatttttagtagtgaagaggaagaggaggaggaagaagagatgttaatcagtgaagaggagataccattcaaagatgatccaagagatgagacctacaaaccccacttagaaaggcatgtctcagattttactgcagacatgttaatgaaatataagtaggaaagcactgttgcatgcttttattttatctgttgccaagctaatgggtatagaattaattttaaatgagtaattattatgcacttcttttgtaagtctaacaccttaatataccctgataataatcctctttcccatttgtagaactttattttgattatatacaagtttttatgagtctgcatgttttatttcaacaaggtatcatgaattgcctgaatacttagaattttttaactaattgtctcgtttctctttacaattatagtgaaatttgatttacaggcatctttagtctggggagggttcattccatgagcaacatatacatatatttggatcattactatgcatgtgaggatgattggtaggaaatcacatttcatgaactgaggaaggtagttttataacaaatcagtgataactctaagctttaatttgttgtcatagtcttccttgaaaagatcttttgtctagtattgaaatgcatttgtgttttcagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296938 - DNA, 4957 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttgcaatactaaaatattttttatagactttatatttttccttttgataaagggatgctgcatagtagagttggtgtaattaaactatctcagcagcatccctttatc

SEQ ID NO: 296939 - DNA, 1235 bp, Homo sapiens
tctgtgactacccaccagttcctctaagcacatactccgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296940 - DNA, 1318 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagtgtacagccacatacaaacaagaacccccccgtgccgaat

SEQ ID NO: 296941 - DNA, 782 bp, Homo sapiens
atccccttagtcaaaaggaaaaatataaagtctataaaaaatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaa

SEQ ID NO: 296942 - DNA, 1937 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagtgagtaggcaattattaaaaatgaaaatctaacagattttgaacgactagtggaaaaaagagtgggagtgtgaggaaggatgttgacgtatacatgcttcaaaatatgtattttttaacttaaaaaaatttggcctcaagcagctgacaatttcactggagagactcttagtaaaaaaatgtttaggtttttcagttctattgcaaggagaaggtattttttaatcttagtgtttttagatgatacatggtagcaactctaaaagtaatacattgagattcttctaagtctttcatagtattgcatagtttatggaaggtatatatttaatctgtcttacagactgatttgaaagtgaaattacttcagggtaaaattacttgcttgatttgccagatatatctttgactttatgtattcttggttatcctttgccacttgttctttggccgtgtgtgtgtgtgtgtgtcttcagccagccttcactgtgtagttttgattcagaatatgtctactgttaccctgtcttcaattacaggagaggaagaagacgaaaagatgacaaaagtccacgtttacccaaaaggaggtgaggaatttttacccctactgttttacaccttattccagtaccaggcactttactcacaaatttagacttcatgataatcctgcaggaatggctatttaaaaatttcacaaaagcaacttcactaatgtcctagatgcacaggtgttatgatcttattttcattgtaagagcttgaaatttctgacaatcttaatactttacctttggggggtcattagtttatttgtgttactttttaattctgtcaaatatttgctaattcttggttacttctaatacaaattctgtgtaatctgtatagtagtaaagag

SEQ ID NO: 296943 - DNA, 2485 bp, Homo sapiens
ggcagggggtggggggggcgccctcggagccgggcggaggggaggggggaaagaggagcgcagggtgagagtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaaggcatgtctcagattttactgcagacatgttaatgaaatataagtaggaaagcactgttgcatgcttttattttatctgttgccaagctaatgggtatagaattaattttaaatgagtaattattatgcacttcttttgtaagtctaacaccttaatataccctgataataatcctctttcccatttgtagaactttattttgattatatacaagtttttatgagtctgcatgttttatttcaacaaggtatcatgaattgcctgaatacttagaattttttaactaattgtctcgtttctctttacaattatagtgaaatttgatttacaggcatctttagtctggggagggttcattccatgagcaacatatacatatatttggatcattactatgcatgtgaggatgattggtaggaaatcacatttcatgaactgaggaaggtagttttataacaaatcagtgataactctaagctttaatttgttgtcatagtcttccttgaaaagatcttttgtctagtattgaaatgcatttgtgttttcagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagtgagtaggcaattattaaaaatgaaaatctaacagattttgaacgactagtggaaaaaagagtgggagtgtgaggaaggatgttgacgtatacatgcttcaaaatatgtattttttaacttaaaaaaatttggcctcaagcagctgacaatttcactggagagactcttagtaaaaaaatgtttaggtttttcagttctattgcaaggagaaggtattttttaatcttagtgtttttagatgatacatggtagcaactctaaaagtaatacattgagattcttctaagtctttcatagtattgcatagtttatggaaggtatatatttaatctgtcttacagactgatttgaaagtgaaattacttcagggtaaaattacttgcttgatttgccagatatatctttgactttatgtattcttggttatcctttgccacttgttctttggccgtgtgtgtgtgtgtgtgtcttcagccagccttcactgtgtagttttgattcagaatatgtctactgttaccctgtcttcaattacaggagaggaagaagacgaaaagatgacaaaagtccacgtttacccaaaaggaggtgaggaatttttacccctactgttttacaccttattccagtaccaggcactttactcacaaatttagacttcatgataatcctgcaggaatggctatttaaaaatttcacaaaagcaacttcactaatgtcctagatgcacaggtgttatgatcttattttcattgtaagagcttgaaatttctgacaatcttaatactttacctttggggggtcattagtttatttgtgttactttttaattctgtcaaatatttgctaattcttggttacttctaatacaaattctgtgtaatctgtatagtagtaaagag

SEQ ID NO: 296944 - DNA, 386 bp, Homo sapiens
gtacttttaaaatgtgtttatcaagtaggtaattgcactgtgctttagttttgcatgttggtaatgataacgtttttctaacataagtcttaaaagattctatagtcaagtgcggggaaaaggtgtgaaaataaaatgtagtaagacaaattttacaagggatgggcagactaggacttttgaatttttatcctttgacttcttgaacttctatgaccgggataatgatcttctattgagcatttattctgtatcaactgtggactaaatacgttatgtatattattgctaattagtctattcaacaccactaaatttgtttatattgatcttattttacagctaagaaactagaagcttggcaggattaagtaacctgcccatgg

SEQ ID NO: 296945 - DNA, 442 bp, Homo sapiens
tgaaggtttgccgctttacaaacatattagttgccactgctgtttactttcatcaaataaatgagtggatattgattgggggcattagttagtagcctttttcttagtttccctctgtttttcaggcaaacagaagaagatcagattagttttccatctagtaacatttcccaatccttcaaaagaagtatgttactgattattgtgtgtgtgtgtgtgtgtgtgtgtgtgtatgtatatatatgctctaaactctaaccctgatcctgaataagagcactctttatttctctgttggatcagccatttccttttctcctctccttagatgtgagatctgtggatttacttgtcgacaaaaggcatctcttaattggcacatgaagaaacatgatgcagactccttctaccagttttcttgcaatatctgtggcaaaaaatt

SEQ ID NO: 296946 - DNA, 386 bp, Homo sapiens
tgagagtcacatctcttatttggaccagtatagacagaagtaaacccagctgacttgtttcctgggacagttgagttaagggatggctttcacagagcattcaccgctgacccctcaccgtcgggacctctgtagccgctctatctggctagcaaggaagattcgttcagacctgactgctcttacggaatcctatgtaagttgcctattttgctgttatctgttttcccttcatcttttttgatccagcaacttaccatcacgcatcagctccattaccaattgtgaaagctctaatcatatagtcattcatataggttatttgacatgggcccttcccttgaggaaacccatgtgactttattttcttcctctgggctgtttag

SEQ ID NO: 296947 - DNA, 520 bp, Homo sapiens
  misc_feature (497)..(497): n is a, c, g, or t
  misc_feature (499)..(499): n is a, c, g, or t
  misc_feature (504)..(504): n is a, c, g, or t
  misc_feature (508)..(508): n is a, c, g, or t
cactgaagaaaactaaaaacaaaatataaaacacatcctcttaaaataatcaaaagacactccacatttgagtcaaaattgctaaagtgaagaatattgtgaagaaccacccataaatcaggcctgaaatatttcttccgtggttaccaagttatcggaactccccacaagatcctcagtgtggactgagaaagaggaagctgtgcagaaggactagctactatagataactgagccacttgagcatgcagcttagttgtacctttgggacccacttgtgcctgatctcatatatattacttcatctacacatgcccaactttacaatttcatgaataaagtaattcccagttcgtggaaaaaaaaaaaaaaaaaaaaaaaaataaaaaaaaaaaaaaaaacaaaaacaaaaaaacaaacaaaagaagaagagagagagagaaacacacaaacaaagaaaaacaacacaaaaacagagacacgacaacaacaaaaanangacanacanaaaaaaaaacaa

SEQ ID NO: 296948 - DNA, 311 bp, Homo sapiens
  misc_feature (271)..(272): n is a, c, g, or t
agctgctcttcgctaggccaaatagtatcccagctttctgccagctactagctacctgtagaggtatatgaagttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgaccccccctctttttttnnccctcctcccccacccccctaccccctacaacaaaaaac

SEQ ID NO: 296949 - DNA, 1208 bp, Homo sapiens
gggaagcatggtatcaacgcagagggcccattacggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagatttgttttcatgtttacttttcttatgtttatatttttagcatttgatcgccattttcccccatccaggttatgtctaatgttttaataaatgttaagaaaaatac

SEQ ID NO: 296950 - DNA, 1247 bp, Homo sapiens
  misc_feature (1224)..(1224): n is a, c, g, or t
  misc_feature (1226)..(1226): n is a, c, g, or t
  misc_feature (1231)..(1231): n is a, c, g, or t
  misc_feature (1235)..(1235): n is a, c, g, or t
gggaagcatggtatcaacgcagagggcccattacggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296951 - DNA, 1136 bp, Homo sapiens
  misc_feature (1089)..(1089): n is a, c, g, or t
  misc_feature (1092)..(1092): n is a, c, g, or t
  misc_feature (1099)..(1099): n is a, c, g, or t
gggaagcatggtatcaacgcagagggcccattacggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttttttaaaaaatcnttnaattacnagaaaatgtcgacgcggccgcgaatttagtagtagta

SEQ ID NO: 296952 - DNA, 1224 bp, Homo sapiens
  misc_feature (1201)..(1201): n is a, c, g, or t
  misc_feature (1203)..(1203): n is a, c, g, or t
  misc_feature (1208)..(1208): n is a, c, g, or t
  misc_feature (1212)..(1212): n is a, c, g, or t
cgcgggcagtgctgctcctggccggtggaggcggcggctgcggcagcggaaggggaagcgctgaggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296953 - DNA, 2080 bp, Homo sapiens
  misc_feature (2057)..(2057): n is a, c, g, or t
  misc_feature (2059)..(2059): n is a, c, g, or t
  misc_feature (2064)..(2064): n is a, c, g, or t
  misc_feature (2068)..(2068): n is a, c, g, or t
tggtaccggcccggccgtactgggatgcggaagcttgtccctttcgttctttgcaataaatcttgctactgctcactctttaggtctacactgcttttatgagctgtaacactcaccgcgaaggtctgcagcttcactcctgaagccagcaagaccacgaacctaccagaaggaagaaactctgaacacatctgaacatcagaaggaacaaactccagacgcgccaccttaagagctgtaacactcaccgcgaaggtccgcggcttcattcttcaagtcagtaagaccaagaacccaccaattccagacacactaccttggctcacggcaacttctgtctcctgggttcaagtgagtcttgtgcctcagcctcccaagtagctggcgattacaagttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcaagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296954 - DNA, 1163 bp, Homo sapiens
  misc_feature (53)..(53): n is a, c, g, or t
  misc_feature (1140)..(1140): n is a, c, g, or t
  misc_feature (1142)..(1142): n is a, c, g, or t
  misc_feature (1147)..(1147): n is a, c, g, or t
  misc_feature (1151)..(1151): n is a, c, g, or t
aaaatttttttatcaacggctccgcggttttgagttgtagaggccaaggttantagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296955 - DNA, 1036 bp, Homo sapiens
  misc_feature (1013)..(1013): n is a, c, g, or t
  misc_feature (1015)..(1015): n is a, c, g, or t
  misc_feature (1020)..(1020): n is a, c, g, or t
  misc_feature (1024)..(1024): n is a, c, g, or t
ggcttgtgctctcaagtgtgccatggcgctatatctagatactcctctagtgctttgcatgtattatctcatttaattagtacaacttccccatgaggtagatcctgctattaattccattttatggagaaggcaactgagccacagaggatttaagtaaccagcccagagtaagaactagtaggcagttcaatccagatttaaacttgaggagttggattatattgttctttactcctgtatccaccactacattattctgccaagtatgttaaaacaagtatataaaaattcttactgcttgatttaaaaagggggtatttaagcatgaaaataagcctacaggtttatagctcctttaaaactgggactttgagactcagagtaagatatgtatttaatgtactgatttattatttaggagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296956 - DNA, 2703 bp, Homo sapiens
gcggccgcggcccctttaaggagcagctctgcggtaacccgagcccgcagtccgggcgggcgcgacggccgccgcggtagctggagcctccgcgactgcacctccaagcggcccggaacccgcggcttccctggctcccgtgagcatctcaccgggcggcactggccagcgccagccctcgggccggcccggatgaccagactcctgtagacacccgccgccctctcccggctcggcgcagccgccgcccgcgcgcgactcgccccgggacccggcacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcaagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccaaaaagttaaatgttgagtatgaatctggctattttctgctttaaatggtgtgtctttaagtgtgttttataacaatgggatagattaattattaagatgtttctgctttcattattacaaccttaatggatcttccttttctttttaaagaatgtctgactgctaattacaagtacaaacttgcaaagcttgaagaataagattgcattttaaaaatcatgtcacttaataaagtgacaggttatttaaaagctctgtggcacatgagtgtttgtttctgtaattagctatgagcttgaattttataaatgtgcactaaaagtttgtgcatattaatatttcttcccatagttaggcacagcaaggtgtgtatttgtggatagtctgcaagatttgtaactttctggctgttaaaaatacattctgacactttaatttggtatctataatacctggaaagaggagcttgtctgttataaccgagatttcatgttagtagaagtagaatcattagggctgtcaacttgtcacctcctacctaacttttgctttccacctgacttgtctcagcagttgctttcaaaatcatcatcttcttcagatttttcaagttcttattctaaactcatctgacctgttttaggtgggacaagatgaggaaaactgttttttatattttaaatattagaagagctacaaatcaataggttttatactttcagataggttaggtcatgaataattacatttgaatttatttaagacaaatttagtgtgaacagtgaatttatttaagacaaatcttaaagatttgtagaataatgacttagttttttcatgatgggctcttaccacaaaactgctttggcatttggttaaccagactcatgctgggttaaagtatatagatataacagtaattcagatttaatgcatatcttggattgggactgactgaggaacctcttgttttaaagtgatttgtagtatatctataacgtttgatccttttgggtaaaatagtagctgacaaaaaataaatacaaattaattttcatgctcatctttacctgaaagactcagatttctctttaagccagctcaggaatattaggctaaacccagctgttttgcagatgttcttactcagattgaaacatcaattaattaacaggtatctattcatatttaactagaaccctgctaatgtagagaaataatacttttttaggagatcttttttcagttctctctaaaatgtcattttatataaatttctcttatatttttataagattgtatactaggattgaggatgtataggtacatatttatagatgctatcaatttgg

SEQ ID NO: 296957 - DNA, 737 bp, Homo sapiens
ctaaatgtttcccccaagaaaaagggagaaaactaggtgcacggctctcttatcttaccccgctacagaccaaaggctgtagtcactggaaacatggacttgttttcatctctaactctccacctctccacactcagcctgcagagcccggccaacaatcagtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagatttgttttcatgtttacttttcttatgtttatatttttagcatttgatcgccattttcccccatccaggttatgtctaatgttttaataaatgttaagaaaaatac

SEQ ID NO: 296958 - DNA, 441 bp, Homo sapiens
gggaagcatggtatcaacgcagagggcccattacggcggtggggcccacagccatggcggagcctgtgcaggaggagctctcggtcctggccgcgattttctgcaggccccacgagtgggaggtgctgagccgctcagagacactccacatttgagtcaaaattgctaaagtgaagaatattgtgaagaaccacccataaatcaggcctgaaatatttcttccgtggttaccaagttatcggaactccccacaagatcctcagtgtggactgagaaagaggaagctgtgcagaaggactagctactatagataactgagccacttgagcatgcagcttagttgtacctttgggacccacttgtgcctgatctcatatatattacttcatctacacatgcccaactttacaatttcatgaataaagtaattcccagttcgtg

SEQ ID NO: 296959 - DNA, 1153 bp, Homo sapiens
gggaagcatggtatcaacgcagagggcccattacggcggtggggcccacagccatggcggagcctgtgcaggaggagctctcggtcctggccgcgattttctgcaggccccacgagtgggaggtgctgagccgctcagaccagaaaataacacagagacaaaactgaaaactgatcacatgagagcaacagactcaacatatgtcaacaatcgtggacaagctgggctcccagatctcaaggctgaccggcacagactgcatgttcactgggagctacctgacttcttcacgcaaacacctccaacagctagcatgtggacctcaacgtggaaaagacaactgcaccgagaaccactgacttagcgctactgctccgaccacacacacgctacccgacagaacacaacaaggtttctcggcactctcgaaccgtcaccagccgctacttcagccgctcggactgaactccaccaacaccacggaccctcctgaacaccctgcacggactccacggaacgcctttttccttccccacattctcgtaccttgcctcccggtacacactgacacacggaaacgacccgcgaactccttcccagccaccccatcacgccagcgccccaccccgcccgccccccggcgcatctgcgccctctccgcgggggacgccgcgctccacctggcaccactagcccacactcctcaccacgctctccccctgccccgccccccactgcaccacggcccttcactccctaaacctccccgcggacaccccaagcccagctacagcacctcatgcgaaacatcactcacccccttgccagcgaaccccctcggtccatcatcctacatgcctccgccccaggcccccgcggccccagcgccacggctacgcaatgcacccacccaccccactccaaccccccaacacacgctccacccacacgactgcgcccaccctgcagcccccccccgccccccatccccacccaaccacccgccccgcgaacccaatgttcagccccccggcgcatcccccccccggtcatccacacgcaccccccaccccccccaccaaccaccacaccagcccacccacacacccagccgcgccccgcccccccccccccccccccacccccccccccg

SEQ ID NO: 296960 - DNA, 1966 bp, Homo sapiens
  misc_feature (1943)..(1943): n is a, c, g, or t
  misc_feature (1945)..(1945): n is a, c, g, or t
  misc_feature (1950)..(1950): n is a, c, g, or t
  misc_feature (1954)..(1954): n is a, c, g, or t
gcggccgcggcccctttaaggagcagctctgcggtaacccgagcccgcagtccgggcgggcgcgacggccgccgcggtagctggagcctccgcgactgcacctccaagcggcccggaacccgcggcttccctggctcccgtgagcatctcaccgggcggcactggccagcgccagccctcgggccggcccggatgaccagactcctgtagacacccgccgccctctcccggctcggcgcagccgccgcccgcgcgcgactcgccccgggacccggcacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcaagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296961 - DNA, 1913 bp, Homo sapiens
  misc_feature (1890)..(1890): n is a, c, g, or t
  misc_feature (1892)..(1892): n is a, c, g, or t
  misc_feature (1897)..(1897): n is a, c, g, or t
  misc_feature (1901)..(1901): n is a, c, g, or t
gcggccgcggcccctttaaggagcagctctgcggtaacccgagcccgcagtccgggcgggcgcgacggccgccgcggtagctggagcctccgcgactgcacctccaagcggcccggaacccgcggcttccctggctcccgtgagcatctcaccgggcggcactggccagcgccagccctcgggccggcccggatgaccagactcctgtagacacccgccgccctctcccggctcggcgcagccgccgcccgcgcgcgactcgccccgggacccggcacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcaagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296962 - DNA, 1855 bp, Homo sapiens
  misc_feature (1832)..(1832): n is a, c, g, or t
  misc_feature (1834)..(1834): n is a, c, g, or t
  misc_feature (1839)..(1839): n is a, c, g, or t
  misc_feature (1843)..(1843): n is a, c, g, or t
ccgggcgccccgcattcctctcgcgtttctcgggctgcacgattccggctgccctgtctgcctggcggtgcctctcgggtctgagcttaaagcgggtgggtgcaaacctttgggcatccagggagagctttcttgttagagcccacacacaatcgggcgcatcaagtgggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcaagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296963 - DNA, 1179 bp, Homo sapiens
  misc_feature (1156)..(1156): n is a, c, g, or t
  misc_feature (1158)..(1158): n is a, c, g, or t
  misc_feature (1163)..(1163): n is a, c, g, or t
  misc_feature (1167)..(1167): n is a, c, g, or t
ttttcaagactttccccctggactaccaacatgtttctttcctgtggttccctgcaccagagaggacccgagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccagagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagaaaaaanangacanacanaaaaaaaaacaa

SEQ ID NO: 296964 - DNA, 1516 bp, Homo sapiens
gcggccgcggcccctttaaggagcagctctgcggtaacccgagcccgcagtccgggcgggcgcgacggccgccgcggtagctggagcctccgcgactgcacctccaagcggcccggaacccgcggcttccctggctcccgtgagcatctcaccgggcggcactggccagcgccagccctcgggccggcccggatgaccagactcctgtagacacccgccgccctctcccggctcggcgcagccgccgcccgcgcgcgactcgccccgggacccggcacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcggtggttctttgaagctctgaagtatcccaagttttctaaagctatcgttatcaatggaatactcatgacagtagtattcttcatcgtgcggattgcctcaatgcttcctcattatggcttcatgtattccgtgtatggaacagaaccctacataaggcttggagttttaatccagttatcctgggtcattagttgtgttgttttggatgtgatgaatgtcatgtggatgatcaaaatttcaaaaggttgcatcaaagtcatctctcacatcagacaagagaaagccaaaaatagtcttcagaatggaaaacttgattaaaagagtgctaccgataagcaaacttcattactacccagcatatctgctgataggatgaattcttggcatgttcttgtgtacctttcttaattataattgttattcaggatttcagtgtcattttttttaaaccttagaaaagagaaggccgggcacggtggctcatgcctgtaatcccagcactttgggaggccaaggtgggtcgatcactgaggtcaggagttcgagactagcttggccaacatggtgaaacctcatctctactaaaaatacaaaaaaaagtagctgggcgtggtggttggcgcctgtaatcccagctactcgggaggctgaggcaggagaatcgcttgaacccgagagacggaggttgcagtgagctgatattgtgccactgcactccagcctgggcgacagagcaagactctgtctcaaa

SEQ ID NO: 296965 - DNA, 1441 bp, Homo sapiens
tcagattcaaccttgaggacattagaaatatagatggcttctgtatccaaatctgaatggaaatgagattacccttctgggttcagatacccctcccaagcccccgtcttttctgtaaccacccctcctctgagccccatcatggctggggttggtatggaatgggagcagctctgtatctggggaagtcctccagcctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccgggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtatt

SEQ ID NO: 296966 - DNA, 1090 bp, Homo sapiens
cggaagacgtgttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtatt

SEQ ID NO: 296967 - DNA, 2007 bp, Homo sapiens
caaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccacctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccgggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtatt

SEQ ID NO: 296968 - DNA, 1876 bp, Homo sapiens
agggagacatgattacgtggcggaaagatcctaatggtgtgtcctggatgtatcctaatcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccacctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccgggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtatt

SEQ ID NO: 296969 - DNA, 1249 bp, Homo sapiens
caaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgccttttttt

SEQ ID NO: 296970 - DNA, 1030 bp, Homo sapiens
caaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccacctcaccttcttggctcttaagtggtaggctgttaccacttgccagcctgggcctcctctctccccaccctttcacaaggcaggctgcccttccgcactcactggcccatcccttctttctcatcgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtatt

SEQ ID NO: 296971 - DNA, 3405 bp, Homo sapiens
tcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatcacaaatctttattggtattattttatatacttttccagcttgataattttcacaatagaaagagaccaaatattttgtactatattttgtgacatagaagtaaatgacaactctaccttggaagatatgaagaaatcagtgtttttatgttcaaaaactattttaaatgtcataggcttgccaattgtgttaactatttagtacattggtagtttttaaatgactaatgctggagtgaaaatgtaaggcaaaatatttagtatattaacagtagatagtcattttcatgtaatcagaattgcatgttaagggttttaaaagctgtcataactcttaccttttatttctaccagtgatcaatcatttctctttacaaatttagggaggaaacaactgttcaaatgtataggggacagaaacctgacatttagagaacagaaattttaattgccaaattaaagcagctaggctgcccctgggcttaacaaaattcctatttttgaactagacccgaggtattttatcattattatttgataggtaccattaacctttgttttgtgattatcgacttttggggggaaagatgagtaattaaacacactcgcccattttctaagtggtttagaaggttgcagtctgcctcaccatacaaagccagtttaaataggaatatatcacatcatacttcacatagcagtcaacctcagaggaaagtcatttattcagaaggcatagattttgctagacagcagtgatgcattacaaatatataattatttgcactaatatttgagcaggtggaatggattagaacatggtcaacatcatgctgctgataacatgtatttttctatattaatatgtactgtgcaacatgtattaaaattgtcaataattcattttagccaagatactaatatttatattactgtgtttaagagacagtatccaactgagccacttttaatttaaaagtctgaaactggaattaagtttactttcaaaaatcacttaaattactttataatcagtgaaaggtcagtaaaatgtagaattataagtgcctagtgacttaataggaggaaatatggagggttaaggaaggaagtaggaacctggaataagaaagctaagtttcatttatagttccaatgagtgactttctttgttttcaccactgggaatcttaaatgaagaaagtgtcgtatcccttccagttatctttatgttaataaactaagtgaagtttggatagaactaacaaaggaattagtctccattggtggacttccagagtttt

SEQ ID NO: 296972 - DNA, 2102 bp, Homo sapiens
tcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatc

SEQ ID NO: 296973 - DNA, 1632 bp, Homo sapiens
tcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgt

SEQ ID NO: 296974 - DNA, 4501 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296975 - DNA, 1572 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgc

SEQ ID NO: 296976 - DNA, 882 bp, Homo sapiens
caataagatatatatctggaggtaaattgtttactgagatgatatttattagaataactactaggttaaaaatgcttcacagtttttagccttctgtcacagatgagtatgttataaatgtttccaaagtttatagagcatttgagtaagtaattttcttatcttgaattagctacaatttgattccaaatacaaagttcaggtacaagaaataaaacatttttactattttttcaggtatttgaacttttttctatagattcccaaatgacaagtgacttttctttgttatttcttctctttcttacctatccatcttaaccccatttaagaacaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaagatgcggccgactccgccccctcatcccacccggacaactcggacggacct

SEQ ID NO: 296977 - DNA, 4551 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctggtatagaaaaacattttggaaatttctacagaaaaagtaaaattgttactagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296978 - DNA, 4402 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctggtatagaaaaacattttggaaatttctacagaaaaagtaaaattgttactaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296979 - DNA, 4447 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaaggggtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296980 - DNA, 4383 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaacaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296981 - DNA, 4345 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctgtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296982 - DNA, 2556 bp, Homo sapiens
tatcccagttaaatgcttacgcaagtcagggcttctcacccaccagctcttcacacttaggtcgcagtgcctcctttcactttaccccccgccacaggacgattgctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296983 - DNA, 2784 bp, Homo sapiens
caataagatatatatctggaggtaaattgtttactgagatgatatttattagaataactactaggttaaaaatgcttcacagtttttagccttctgtcacagatgagtatgttataaatgtttccaaagtttatagagcatttgagtaagtaattttcttatcttgaattagctacaatttgattccaaatacaaagttcaggtacaagaaataaaacatttttactattttttcaggtatttgaacttttttctatagattcccaaatgacaagtgacttttctttgttatttcttctctttcttacctatccatcttaaccccatttaagaacaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296984 - DNA, 2599 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaagatgcggccgactccgccccctcatcccacccggacaactcggacggacct

SEQ ID NO: 296985 - DNA, 915 bp, Homo sapiens
  misc_feature (25)..(26): n is a, c, g, or t
tcgacggagactctctataatattnnaatgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataa

SEQ ID NO: 296986 - DNA, 1310 bp, Homo sapiens
catccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctaattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgatgggactgactagttgcaggaaaacgagcttaaggctctcactgatt

SEQ ID NO: 296987 - DNA, 436 bp, Homo sapiens
ctataacctcgtattctcatgggactaatttttacaatgtggttttgatactgtaaaacaaacaaaaaaagatctaggaatgaaattgtcatgttttaaatgaaacagactgcaccaaagcaaaaaattctcaaatgtgtgtgaggggtcaggagaatccccactgacttacacaaataaagaacatgtgtgttctaggaggggtattcctgggttaagaaacttccctaaggggaaatatgaattgttagttgagtgatcttcctctcaaggcaaccgaagcagtaattgttgtctgccgtgttgggaggttagccacctgcctattgtcttttcttttgaaaactttttctctgagaagtgaatgtactgagtggtaaaagactttaaattatttgctaacttttcagagtcaaacagatgaaatccctgtatt

SEQ ID NO: 296988 - DNA, 685 bp, Homo sapiens
ggcttaagctttgaagtcattagaacaaaatacagtgctttgaattgtagtgtttgtgttcatcttgagttgctttaattgttaaatgataaggtaaggccattttaaaataaaaactccaaatgaaaagtgttaaattatttttaatacataaatcccatgacatgtccagatctgtatatagtaatagctataaaagaagggcaaaaacagatgggtttagaacagagttactgctctcacttttatttgtagaatataaacatctttggcacttatgcatgatttaccatctttgctttttaatctttttaaaaaaatggtcatttttgtttgttaatatgatttactgtactacttttattattcaataggtcacatatcctggagcaggaaaacttccacacatcattggaggatcagatctaatagctcatcatgctcgaaagaatacagaactagaagagtggctaaggcaggaaatggaggttagtaggaagtgaggcccagaaacttgcttaaattgcactttggtccattatggtggccttcaagcaaattcttcttaaaaccaaattaaaataagtgacataaagtcattcattcaggagcattcctgagttacagagcattaatctatacccttccataacacttctttaaaagaatactaaatttatttttg

SEQ ID NO: 296989 - DNA, 459 bp, Homo sapiens
ctttcttgggatggtaaaatatattcagtgtatttttgtctaaaaattatcttctaaggttatattacgttagaactatttaacgatctttgtttctctattaaagttgctgtaaacttgattatttaccttgcattcttttctttttctacagggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaaggtctgtttttgataacttctctcatgtctctg

SEQ ID NO: 296990 - DNA, 639 bp, Homo sapiens
ttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagttgaa

SEQ ID NO: 296991 - DNA, 1532 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacaaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacgga

SEQ ID NO: 296992 - DNA, 1472 bp, Homo sapiens
  misc_feature (1094)..(1094): n is a, c, g, or t
  misc_feature (1352)..(1353): n is a, c, g, or t
  misc_feature (1355)..(1355): n is a, c, g, or t
  misc_feature (1370)..(1370): n is a, c, g, or t
  misc_feature (1384)..(1384): n is a, c, g, or t
  misc_feature (1393)..(1394): n is a, c, g, or t
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtgactacaattgcaaagtagaatttgctttgacacctgatgccaggacaatagtatgttaccatccttctatagacattccatatgaacgcacaaaacctatcccttgaccagatcctgtgtataataatgaagaaacacatggtcaagtgctgaaaactagagaagaaaaaagtgaacaccttgagcgagaacccataatagaacaacttagcaaaatgttctttatgctaagtacggttggcatcttcgtggacattagcacagatgtcagaagaaaccggaacctccagaagacagatgatattgaggttcttggggaattaaagagaaatattaccctctgcctcatttgccattggagacagtgcaatctggtgtatgcactaataataataataacatgtcttttcatattttaaaaaaaaacacaaaatctttaggaagccgaggtgggtggatcgcttgagtcaggagtttgagagcagcctgagcaacatagaccccatctctaaaaaaaattagccaagtgtggtgatgtgtgtctgtggtgccagctacttggaaggctgaggtaggaggantgcttgagctcaggaggttgaggctgcagagagtggtgatcatgcctctgcattccagccttggtgacagagcaagaccctgtctcaaacaacaacaacaacaaaaatcaaaatctatgcaaaatttaaacccaatcttgcgctagtcttgtgggaatgaagattaatttacctaaaaatgctcctctggtttttgtaattctttttgttactttttaaaaatataaatttggccaggcacggtggctcacacctgtnntntcagctactcgggangctgaggcaggagnatcgcttgnncctgggaggcggaggttgcagtgagccgaggtcccgccactgcactccagcctgggtgacagagtgagactctgtctc

SEQ ID NO: 296993 - DNA, 914 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagcgcggagggccggagacgctgcagacccgcgacccggagcagctcggaggcggtgaataatagctcttcaagtctgcaataaaaaatggcctccaacaaaactacattgcaaaaaatgggacaacaccagaatggaaagagtacaaaacagttgaagaggcagacgctgaagaatttgtcgtggcaaaagtactagatcgacgtgtagtgaatgggaaagtggaatatttcctgaagtggaagggattacagatgtgacatacttgggaactgagaaaatttagatggtcagaatgttgacggttctatctagcaaggtgccaagacaagatgtccaccaggaaatctttctctgaggggattggtgcgcactcaagacgaaaggatgtggtgcaaccagaggttgcggaggtggactgggaaatatgggccaaccgggatgtggttctgaggcacgtcatcggcctggggggaagagatataggtccggtggttaagacccgtctgcgagagccatcgcagctttttctataacaggcgggcgacaaaactatgcgggtc

SEQ ID NO: 296994 - DNA, 967 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagccattttattttaaaaatatttcctgacttcggatgtggcttgagctggtaggcgcggagggccggagacgctgcagacccgcgacccggagcagctcggaggcggtgaataatagctcttcaagtctgcaataaaaaatggcctccaacaaaactacattgcaaaaaatgggacaacaccagaatggaaagagtacaaaacagttgaagaggcagacgctgaagaatttgtcgtggcaaaagtactagatcgacgtgtagtgaatgggaaagtggaatatttcctgaagtggaagggattacagatgtgacatacttgggaactgagaaaatttagatggtcagaatgttgacggttctatctagcaaggtgccaagacaagatgtccaccaggaaatctttctctgaggggattggtgcgcactcaagacgaaaggatgtggtgcaaccagaggttgcggaggtggactgggaaatatgggccaaccgggatgtggttctgaggcacgtcatcggcctggggggaagagatataggtccggtggttaagacccgtctgcgagagccatcgcagctttttctataacaggcgggcgacaaaactatgcgggtc

SEQ ID NO: 296995 - DNA, 1826 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacaaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaatagcagtgtctgtggtgctgttgactcgattgctcctggaaggatgttcccaggcagcaggaggtaaagacaaatgcatgcaaaggcatgggagctggccactttgccagcctcctgttattagcatgtgccctcagacagtccagactttggtgttctgaggccttagctccatgggccttcttcctgggtaatagtttacaaatccctaaagatcagtagggtgtctgtaaaaatcttccgatcgagagaggagctaaaagaaaaaatagaataaataaatcttctgagaa

SEQ ID NO: 296996 - DNA, 1795 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaatagcagtgtctgtggtgctgttgactcgattgctcctggaaggatgttcccaggcagcaggaggtaaagacaaatgcatgcaaaggcatgggagctggccactttgccagcctcctgttattagcatgtgccctcagacagtccagactttggtgttctgaggccttagctccatgggccttcttcctgggtaatagtttacaaatccctaaagatcagtagggtgtctgtaaaaatcttccgatcgagagaggagctaaaagaaaaaatagaataaataaatcttctgagaa

SEQ ID NO: 296997 - DNA, 2011 bp, Homo sapiens
tcctgggctccgtcagctaggggactccgcccctcccgatttcctccgggctacaggcgacagagctgagccaagcgtttactgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacaaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaatagcagtgtctgtggtgctgttgactcgattgctcctggaaggatgttcccaggcagcaggaggtaaagacaaatgcatgcaaaggcatgggagctggccactttgccagcctcctgttattagcatgtgccctcagacagtccagactttggtgttctgaggccttagctccatgggccttcttcctgggtaatagtttacaaatccctaaagatcagtagggtgtctgtaaaaatcttccgatcgagagaggagctaaaagaaaaaatagaataaataaatcttctgagaa

SEQ ID NO: 296998 - DNA, 1474 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacaaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtgactacaattgcaaagtagaatttgctttgacacctgatgccaggacaatagtatgttaccatccttctatagacattccatatgaacgcacaaaacctatcccttgaccagatcctgtgtataataatgaagaaacacatggtcaagtgctgaaaactagagaagaaaaaagtgaacaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaaaccctggagaaatgggagcttggggagaggatgggagtgggcagaggtggcacccagggcccgggaactcctgccacaacagaataaagcagcctgatt

SEQ ID NO: 296999 - DNA, 1570 bp, Homo sapiens
tcctgggctccgtcagctaggggactccgcccctcccgatttcctccgggctacaggcgacagagctgagccaagcgtttactgggcagctgttacgagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacaaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaatagcagtgtctgtggtgctgttgactcgattgctcctggaaggatgttcccaggcagcaggaggtaaagacaaatgcatgcaaaggcatgggagctggccactttgccagcctcctgttattagcatgtgccctcagacagtccagactttggtgttctgaggccttagctccatgggccttcttcctgggtaatagtttacaaatccctaaagatcagtagggtgtctgtaaaaatcttccgatcgagagaggagctaaaagaaaaaatagaataaataaatcttctgagaa

SEQ ID NO: 297000 - DNA, 1480 bp, Homo sapiens
aattatgcgcagagctgccaggatgcacagctgccattaggagtatccttgtacttcccagtttagcagtgaaaaacaattgtaggaagaaattgctggtgggcgggaaggtagtgtttgagtaactgagataatcattaagtaattaatcagtgaggtctgacacagccacccttttattctgccctttcatagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaatagcagtgtctgtggtgctgttgactcgattgctcctggaaggatgttcccaggcagcaggaggtaaagacaaatgcatgcaaaggcatgggagctggccactttgccagcctcctgttattagcatgtgccctcagacagtccagactttggtgttctgaggccttagctccatgggccttcttcctgggtaatagtttacaaatccctaaagatcagtagggtgtctgtaaaaatcttccgatcgagagaggagctaaaagaaaaaatagaataaataaatcttctgagaa

SEQ ID NO: 297001 - DNA, 2184 bp, Homo sapiens
  misc_feature (1806)..(1806): n is a, c, g, or t
  misc_feature (2064)..(2065): n is a, c, g, or t
  misc_feature (2067)..(2067): n is a, c, g, or t
  misc_feature (2082)..(2082): n is a, c, g, or t
  misc_feature (2096)..(2096): n is a, c, g, or t
  misc_feature (2105)..(2106): n is a, c, g, or t
tcctgggctccgtcagctaggggactccgcccctcccgatttcctccgggctacaggcgacagagctgagccaagcgtttactgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacaaacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtgactacaattgcaaagtagaatttgctttgacacctgatgccaggacaatagtatgttaccatccttctatagacattccatatgaacgcacaaaacctatcccttgaccagatcctgtgtataataatgaagaaacacatggtcaagtgctgaaaactagagaagaaaaaagtgaacaccttgagcgagaacccataatagaacaacttagcaaaatgttctttatgctaagtacggttggcatcttcgtggacattagcacagatgtcagaagaaaccggaacctccagaagacagatgatattgaggttcttggggaattaaagagaaatattaccctctgcctcatttgccattggagacagtgcaatctggtgtatgcactaataataataataacatgtcttttcatattttaaaaaaaaacacaaaatctttaggaagccgaggtgggtggatcgcttgagtcaggagtttgagagcagcctgagcaacatagaccccatctctaaaaaaaattagccaagtgtggtgatgtgtgtctgtggtgccagctacttggaaggctgaggtaggaggantgcttgagctcaggaggttgaggctgcagagagtggtgatcatgcctctgcattccagccttggtgacagagcaagaccctgtctcaaacaacaacaacaacaaaaatcaaaatctatgcaaaatttaaacccaatcttgcgctagtcttgtgggaatgaagattaatttacctaaaaatgctcctctggtttttgtaattctttttgttactttttaaaaatataaatttggccaggcacggtggctcacacctgtnntntcagctactcgggangctgaggcaggagnatcgcttgnncctgggaggcggaggttgcagtgagccgaggtcccgccactgcactccagcctgggtgacagagtgagactctgtctc

SEQ ID NO: 297002 - DNA, 718 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtaatcgattccccgtctagttccagctgaaatcatcctttatgtagttgttctatttgtttttagcccagcagtagatttttaagaacagacttttttgccaaaaggcaaatactgcagctacgtgttggtcacagattgaatagagttaaggataaagcattgtgttcatttttaagtatgcaatgaacttgagaaagtagtaact

SEQ ID NO: 297003 - DNA, 692 bp, Homo sapiens
tcctgggctccgtcagctaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttctt

SEQ ID NO: 297004 - DNA, 1525 bp, Homo sapiens
ctaatagaaaagtgaaaccacaaacctgccaatagcagaatctttagagaaatgacgcgaaactcctgccttaaagccctaaatggcggcttcaatatcagccccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggagattgacgagattcctggggaggcgattcatgacagctgagttccttttggaggatccgtcttcaggcagagcactgccttcctcatgtaccatgcatcaagccctctccccagcctgaagaacaccatgttcctcttagcgatcatcagtaacaaggcgtgccactcgaagaactacaaagataagggttggggtttgtgctggggaaagctcatgacactagctgcaggaatagaggactgagcctcccaagtctggaaagcagagggaggatgccccgtctgatttcctcagcacctttgcagagctcttggtctcctgcctgtgcctgcaggcctgactcacttcctctctgcacgtgagactctgcacacctcctatcgggttatggacgcatggcagctcagccctccatttcatgtgacctcccagctttgctctctacaacacctaacccagtcagtttctgtgtcctaattcaaaattgctgggagaaaaaaaagtctgattggcatttgagtttgagaacgaaggcttgaaagagccagtttgaagaatgggagcaaggcctggctagagcactgatcgacaaacttttcctgtaaagggctgggtagtagatattgcaggctttgcaggccatgaaatccacgctgcattgtagtggcatgcaagctgccatagccaatctgtaaatgaatgagtgtggctgggtcgcattagcattttatttccaaaaatagcaggtggccagatttggcccagggactataattttccaattcctgagatactagaaacagaagtgttttgttgttgttttaactaactctttattgaagtacagcaaacaaaagtatacacattatagcattgtatgaactatcacagagtgactacacgcatgtaaccaccaactgtgtgaagaaaacattgcctgcatcccagaaactatgtatgcacccttactagtcactaatctcacactcctccccaaaagtaactaaaactctgatttgtattgtcagtggtttctcctgttttggactttatataaatgaagtcatattgtatgtatttctactttctgtctaacttctttgtatgatattctcccagtggaattcatctgtattgtggtttgtaccaatggttcatttctttttattggtattataatattttatggcatactattagtattt

SEQ ID NO: 297005 - DNA, 435 bp, Homo sapiens
aaaccatttctcctccgccgccatttcctaccaaccatacagcataataaggcagctcaaacccaataatatatacatcaaaagcagaaaacaaggaaaagtgatttgggattggcaaactggggttgacaagatgatacatattttaggatttgtgggctatgtattatttctcctgcatattcctcttctcttttttaagcaatatttaaaaaatgtaaaaaccattttcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaa

SEQ ID NO: 297006 - DNA, 624 bp, Homo sapiens
ggcatagcatgctgcctggcttatatcccttttctttattttctccatattatttgaactcagagcaggaaatgatattgatgcttaagatttaattatctaacaagattgctcctgaggataccacaaaatactattctgtctgaaactgcaaataatttctaattcctgttgactccttaagaaggttaaagaaccgattatctttattgatttacttagttctttggtacaaaaaaaattcctagctgttctaacacttatctaacatttaaaaatcttttagtactgaattatatctatgcacacactgaatattttcccaagtatcttctccagctgaatatacatttactgacaatagtacgaagtaagcgatgtcctctaaagatttattaaaagcagaaaaatgaacatgcctcttaaccaattactcaaaaacctattctttgaataacttatttctcatagatgtatttattaaatttgtgtacttatttttaaacattatagtaaatgtccaagaaggaagccaagaggtaaatgggatgcagggtgagcccagctcccctggaggcgcacttcccaccaaatcacctggtagttcccttgagcaggtccgtg

SEQ ID NO: 297007 - DNA, 205 bp, Homo sapiens
caaaagatgccccccaagcccaattttgccccaattttgggcacaccccaaagaaaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaa

SEQ ID NO: 297008 - DNA, 1887 bp, Homo sapiens
ctaatagaaaagtgaaaccacaaacctgccaatagcagaatctttagagaaatgacgcgaaactcctgccttaaagccctaaatggcggcttcaatatcagccccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggagattgacgagattcctggggaggcgattcatgacagctgagttccttttggaggatccgtcttcaggcagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtactgacctctgcaattctaaaccgtccactttgggcaaaattcatcaagctatggatatgaaaaaaggccccaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccagaagaaaagttctctagagatgtgctgtggttcacaggaggaagacctccagtggcaatgtccaagaaggaagccaagagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaa

SEQ ID NO: 297009 - DNA, 1597 bp, Homo sapiens
ctaatagaaaagtgaaaccacaaacctgccaatagcagaatctttagagaaatgacgcgaaactcctgccttaaagccctaaatggcggcttcaatatcagccccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggagattgacgagattcctggggaggcgattcatgacagctgagttccttttggaggatccgtcttcaggcagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtactgacctctgcaattctaaaccgtccactttgggcaaaattcatcaagctatggatatgaaaaaaggccccaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccaggaggaagacctccagtggcaatgtccaagaaggaagccaagagtgtaccttaaagagtggagaaacgtgtgcccgttttaaggattcttccaagctgaaagagaaaagtacttctgcctcagcatctcggagaatgtctaaaatttggaaaaacaaaaaatgatgaattaaaaaaggaacaaa

SEQ ID NO: 297010 - DNA, 1719 bp, Homo sapiens
ctaatagaaaagtgaaaccacaaacctgccaatagcagaatctttagagaaatgacgcgaaactcctgccttaaagccctaaatggcggcttcaatatcagccccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtactgacctctgcaattctaaaccgtccactttgggcaaaattcatcaagctatggatatgaaaaaaggccccaaggatatgattcatagtccagcgtttgagtgagcactccagtcagaacgaactctgcattgtgaacatctgaacagggtggaaacagacactttagttagagatccactgctgtgcgtgcacacatactcacacaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccagaagaaaagttctctagagatgtgctgtggttcacaggaggaagacctccagtggcaatgtccaagaaggaagccaagagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaa

SEQ ID NO: 297011 - DNA, 1413 bp, Homo sapiens
gcctcagcacctggaaccaggtggtgctgctacagggtcctccaggaactggaaaaacattcctatgtaaagcattagcccacaaattgactattaaactttcaagcaggtattggtatggccaattaattgaaataaatagccctaacctcttttctaaacggttttccgaaattgacaagctgataactaagacgttccagaagattcaggatttgattgattataaagatgctctggcattttcactgattgatgagatagaaagtctcacagccacccataatgaaagccatcgggtgccattggcatggtcaacgctgtcttgacccaaattaatcagattaaaaggcattttaatgtagtgattccagctacttccaacatcaccgtgaagattgacatggcctttgtggacaggtctgatatcaagcagtatatcagtctgcgctctgcagcagccatcttcaaaatttacgttttctgtttggaagaactggtcaagtgccaggtcatataccctcctcagcagctattaaccctccaaaagctggagatgattggcttcattgaaaacaatgtgtcaaaattgagcttccttttgagtgacatttcaaagaagatcgagggcctccatggccagttcctgaggaaactcctttttctggtgcatacactgtgtgtccaggctacaccaggctttctctctggtcgtggacaagcaggttgaagagaaaaaagaagctttcagcttacatttgtcctgggctcaagcagtctacccatctcggcctcccaaagtgctgggattacaggtgtgagccaccacacccagccagaaatgatttttgactacacctaatattcactttatacaataaacttagaacttaatctctatataagctatttattttaaaattcagaaaagcaaaaaaatatttaaatcattcataaactaaaactacccagagataaacactgtcagtaatatattcaatcttttgtatatctatgttatttacatgtagtgggttgagtagtgtcattcagaaactgatgtcaacctaaaacctcagaatgtggccttattttggaaatcgggtcttggcaaatgtaattagttgtagtcatgccggattagggtgggccctaaatccaatgactagtgtccttagaagaagagcagaagatactcagaaacactgggaaggctgttttgtgataaaggagaccggagggatgttcctacaactagggaacaccaaggattgccagcaaccaccagaagctaggagagaagtaacaagcattctccttcatagcttccggaaagaaccaaccttgccaacaccttgatttggggtttctaacctgaactgtaagagaataaatttccattgttttaagtca

SEQ ID NO: 297012 - DNA, 385 bp, Homo sapiens
cttcattgaaaacaatgtgtcaaaattgagcttccttttgagtgacatttcaaagaagatcgagggcctccatggccagttcctgaggaaactcctttttctggtgcatacactgtgtgtccaggctacaccaggctttctctctggtcgtggacaagcaggttgaagagaaaaaagaagctttcagcttacatttggtcctgggcttcccattccatagctttctagtggagagcacacaaatagtaagtaacatcacttgcctcacaacagccaccactctggaaatcctctctataaaaatttgcttaggtctgtctacaagccagaaacctacaacaccaacctttgttacaagtgttacatttactttagcttaaaatgc

SEQ ID NO: 297013 - DNA, 726 bp, Homo sapiens
tgcagtggcaccatgccggctcactgcaacctctgtcttctgggttcaagtgattctcctgcctcagcctcccaagtagttgggattacaggcatgcatccccatgcccagctaatttttgtatttttaggagaaacagggtttcaccatgttggccaggctgctcttgaactcctgacctcaggtgatccgcctgcctcggcctcctgaagtgttgggattacaggcgtgagccactgcgcccggccaattttaacttttcataatagatttgtatatatttatggtagtaaatgataaaatagactagtgtctacatatattatatgaattcatgacacacctttttcttagtttttcagtatttctaagctacatggtgcatctgcaagttttttaaattgttgcaaatttccaaaaaaattttcaatatatttatcaaaatatgcatataagcggtcctatgcagttcaaacccgtgtttgagaatcaactttatgacttccagtgtcattctccaccatttctgcagtttatcacattttgcttcaggcagatttggtaaatcttcaatgatagttctctaggccattgttttgtaacatgatcaaatgcttaatgggaaatagaatatgtatatgtattctttgtctaccaactaccaaagaaacaaatactcctcagtttgacttgacttagtaaataaacttgtgttgggttaatgga

SEQ ID NO: 297014 - DNA, 746 bp, Homo sapiens
tgcagtggcaccatgccggctcactgcaacctctgtcttctgggttcaagtgattctcctgcctcagcctcccaagtagttgggattacaggcatgcatccccatgcccagctaatttttgtatttttaggagaaacagggtttcaccatgttggccaggctgctcttgaactcctgacctcaggtgatccgcctgcctcggcctcctgaagtgttgggattacaggcgtgagccactgcgcccggccaattttaacttttcataatagatttgtatatatttatggtagtaaatgataaaatagactagtgtctacatatattatatgaattcatgacacacctttttcttagtttttcagtatttctaagctacatggtgcatctgcaagttttttaaattgttgcaaatttccaaaaaaattttcaatatatttatcaaaatatgcatataagcggtcctatgcagttcaaacccgtgtttgagaatcaactttatgacttccagtgtcattctccaccatttctgcagtttatcacattttgcttcaggcagatttggtaaatcttcaatgatagttctctaggccattgttttgtaacatgatcaaatgcttaatgggaaatagaatatgtatatgtattctttgtctaccaactaccaaagaaacaaatactcctcagtttaacccaacacaagtttatttactaagtcaagtcaaactgaggagtatttgttgtcgacg

SEQ ID NO: 297015 - DNA, 809 bp, Homo sapiens
tcagattatcagtgctatggagaaagttaactgttacagtacattgcagagatgggttctgtaggcagtgtgtcacacaatgtttaatgtcatatagctttcatgatgttggatattatctccccctttttttttcttttcctttttttttttttttagacaggctctggctctgtcaaccaggctggagtgcagtggtgcaacctcagcttactacaaactctgcctctctggctcaaggtatccacttcagactccctagtagctgggactgcaggcacacaccaccacacctggttaatttttttccatattttgtagagacagggtctcactttgttgtccaggctggtcttgaattcctgagctcaagcaatctgcccaccttggcttcccaaagtgctggaattacaggtgtgagccactgtgcttggctcccaattttttttctaattaaccccacatctgctgaattaaaggagagtgttaaatacaaaaatgaatttattatgcaaatctgcagttatcgtgtatgttcttttggacttgtaataagggagtatgttctagtattgaagaaatagaaccagagaggaatactgctgtaaaaattaaaaaaaaaaaattcaaaatagggtagcttccagcgaccatgcatgccaacagttagcatgccagcctgttggacctgacaaagtggtccctggctgctgtccatagtgcactattggcaggtctgtttttgttgaaactttgggtcaccatgtgtcagcctatgtatattgtcttctgtcattttttttttcgta

SEQ ID NO: 297016 - DNA, 1520 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297017 - DNA, 592 bp, Homo sapiens
  misc_feature (3)..(3): n is a, c, g, or t
  misc_feature (55)..(55): n is a, c, g, or t
cgntcgagcttgataccgaattcccgccgcttcgacacggtgcgagagacgacanagggcccacagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297018 - DNA, 559 bp, Homo sapiens
acaacccatcaggcagtacgaggctgggtgtagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297019 - DNA, 802 bp, Homo sapiens
  misc_feature (11)..(11): n is a, c, g, or t
  misc_feature (14)..(14): n is a, c, g, or t
  misc_feature (16)..(16): n is a, c, g, or t
  misc_feature (36)..(36): n is a, c, g, or t
  misc_feature (614)..(614): n is a, c, g, or t
  misc_feature (620)..(620): n is a, c, g, or t
atcgacccccnttngnatcggtacgcgctccattgngttaggacttcggaattcggccattatggccggggccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataatatntttttnaccgtataaaaaaagacccttatcaaaaaaaaactatgtcgcccggctttggccaagtcgacttttggatttgagcaagctttaatcatggcggccgaattttgaggttaattgggccaaatttgccctaaagggagccgatttacaattcaattgcccgtggtttaaccgttggctgggct

SEQ ID NO: 297020 - DNA, 530 bp, Homo sapiens
  misc_feature (15)..(15): n is a, c, g, or t
  misc_feature (510)..(510): n is a, c, g, or t
atttcggaacgagcngcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggagtgccaactaacatcggtcatctaactgagtgccactttcaactcccggtgggtgaatatatangtatatataatctttcccca

SEQ ID NO: 297021 - DNA, 355 bp, Homo sapiens
  misc_feature (320)..(320): n is a, c, g, or t
gcggccgcctactactactaaattcgcggccaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatgnagagggagcagcagaggatcctctagatcacccag

SEQ ID NO: 297022 - DNA, 410 bp, Homo sapiens
tgggtccctacttctattgggaaaggcaactagagggcgacacgtggcaaattaccttggtttaagtcttaatgtggcctgtggtgtttcccataaaaaaattggctttgtggcttcatggtgtcctctgggctaatgatggaaaaatcattattggaaaagaatgacatgaacaaaggaaccactgaagtgccggaggactggaggaggaagggggagggtgtgggggcagtgagggtggcagggactaaggcttccttctctaccctagcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297023 - DNA, 572 bp, Homo sapiens
  misc_feature (186)..(186): n is a, c, g, or t
gcctggtgatagctggttgtccaagatagaatcttagttcaactttaaatttgcccacagaacccctctaaatccccttgtaaatttacctgttagtccaaagaggaacagctctttggacactaggaaaaaaccttgtagagagagtaaaaaatctaacacccatagtaggcctaaaagcagccnccaattaagaaagcgtccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataatcttttcaccataaaaaaaaaaaaaaaaaaaaaacgggggggtcaagggcggggggcgggaaaaagggggtaaggacaggggccagggggcaaagcgggtgcccggaccaagtttccgggtgcaagcgggggacaatgggcgggccccctataggggaggggaaataattccgaaagccggggtaccggatagatacgggcagaaac

SEQ ID NO: 297024 - DNA, 2196 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaaggtgtgtgttggtgatggggccgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagttggtcgctttcgcctctggtatcgtgcatatgatggaaaagttttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297025 - DNA, 533 bp, Homo sapiens
aaaggctaggtacgaggcggggggagaaggagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297026 - DNA, 2438 bp, Homo sapiens
  misc_feature (2438)..(2438): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggactttcagagcaaaaaaaaaaacaacaaaaaacaaaacaaacaaaagagaaaaacaacacaaaaaaaaacaaaaaaacaaaaaacaaacacacttgtgtgtgcggcgcgcgcctgcgcgcgccctccggaagaaaccttctttaaacacaccccgcggggtgggcgcccggcgggcccccattggtggatagagaagaaaccgcgtgtggaccaacgggtggtctcacggagaaaaaaatcccggaggacaaaacgaaaatcgggcggagaggcgagcttctcccccacgaaatatataaaaaaacccccgcgcggcggggagaaccacacagcgagcttgttctactgaacgacaacactcccaacaaagggagggggatctcagagagaggaggctaacgaaagagagggggcatcaatccaaaccaggcggggaggacaaccaaagagagagcggcaattgattataataaaatttccggcccggcggctggtcgcggggggggan

SEQ ID NO: 297027 - DNA, 1647 bp, Homo sapiens
  misc_feature (1553)..(1553): n is a, c, g, or t
  misc_feature (1556)..(1556): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaaaaacaaaacagaagaacaaaagncgngatgcgaacaaagcggctaagaaagggaccaggggcataacgtactacagaacccagcttcagaacacgagagaaaccgccgatccccaat

SEQ ID NO: 297028 - DNA, 1944 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaggggggcgacaccaagagccg

SEQ ID NO: 297029 - DNA, 1730 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaaaaaaaaaaaaaaaaaaaaaaaaaaaaaaaaaaaaaaaaaaaagtcgcggggtttttttggggggggggaaaaaaggggtgtagaaaaaggggaggtggtagatgagttgttccgcgaacacccgtttttttgaaacagggggggaatcggggggccccaagaaggaggggaaaaaattgaaaaacgggtaccgtattagg

SEQ ID NO: 297030 - DNA, 1801 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaaaaaaaaaaaaaaaaaaaaaaaaaaaaaaaaaataatcgagagagactatattatggaggggggggagaaaaaagagaggatagtagaaggaagagggacgtgagtgggactataactgtgtggttgatcgttgagaaccaatagattttcttgttgataaaaggggggaaataatgggcggggggcctcctcttataatgagagggggagaataatagtgtgaaaaagcccgggagtacccgggttttaattagttttctggagcaaaaaa

SEQ ID NO: 297031 - DNA, 1644 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaagacattaacacacacaaagaacaacttttggggggcgccttggcccttcgaaaaagttttaaaacccctctgttggggcgccggggccccatttggtttatgagcaccctgggccag

SEQ ID NO: 297032 - DNA, 1550 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataatagacataagagaatagataagacacaac

SEQ ID NO: 297033 - DNA, 1591 bp, Homo sapiens
  misc_feature (1591)..(1591): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatgggtactaaagctcaagaaatgatacttgaaccgcaaaaagtgttacaattcactggccgcggttttaan

SEQ ID NO: 297034 - DNA, 944 bp, Homo sapiens
atcactggttggagctcatgtcccgggcctctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggactt

SEQ ID NO: 297035 - DNA, 1480 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacagaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297036 - DNA, 2193 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaagtaagtttccttcctacaaaccccttaatgctcaccccttgggtgcaaatgatgcatatgttagcgaccaaagcctgatctttgctgattagtcataattaactgactgcacccctatccttgacaaaccttatcctcacattcctcattttgctttctaaaaataacattccagcttaatcttcatatttcaactccagtaacgaggctcccttttgtttttcagattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaggggggcgacaccaagagccg

SEQ ID NO: 297037 - DNA, 1521 bp, Homo sapiens
  misc_feature (1501)..(1501): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggagtgccaactaacatcggtcatctaactgagtgccactttcaactcccggtgggtgaatatatangtatatataatctttcccca

SEQ ID NO: 297038 - DNA, 2857 bp, Homo sapiens
  misc_feature (2074)..(2074): n is a, c, g, or t
  misc_feature (2094)..(2094): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcctgggcaataagagtgaactctgtctcaaaaaaaaaaaaaccctgagtctctcaaaatttgttaggttaattattgcttcacatgtggtcacggtttgaaaacttattttggggggagtataaagtagaatacagagattccttgctcatagctcctactgctatcgggaacaatccttgagggtgagaacgtggattgattcttgattgatagtggggattccattatctgtatttggcagttatggcctgctgcggtgtatagaagcttctttccattcattttcccgaattttcatactgctcaaggaacagttgggggggaatgggcagaaggttgggcacttgagtatttgagctatcggtaataactgactttttagggagcacagatttgagtagagccatggtagtagttagtaccaatgggttttngctgcttctactctttcttnacagaaaaagtggattgtgttcatataggaaagcagttcacagactgtcttcctgcccctcccgccaccaagctggacctagaatcaagtgtgactttaaatggggaaagctgtgttacagttgtgcttaagccactgctgtggcttaacctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctccaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297039 - DNA, 1483 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggcccggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297040 - DNA, 1633 bp, Homo sapiens
  misc_feature (850)..(850): n is a, c, g, or t
  misc_feature (870)..(870): n is a, c, g, or t
taaaaggatagcgtactgctcgatgggtactaggcacatttacgcactcatggtcataggctgctccctgtctaatatgtgtcctccgtaattctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcctgggcaataagagtgaactctgtctcaaaaaaaaaaaaaccctgagtctctcaaaatttgttaggttaattattgcttcacatgtggtcacggtttgaaaacttattttggggggagtataaagtagaatacagagattccttgctcatagctcctactgctatcgggaacaatccttgagggtgagaacgtggattgattcttgattgatagtggggattccattatctgtatttggcagttatggcctgctgcggtgtatagaagcttctttccattcattttcccgaattttcatactgctcaaggaacagttgggggggaatgggcagaaggttgggcacttgagtatttgagctatcggtaataactgactttttagggagcacagatttgagtagagccatggtagtagttagtaccaatgggttttngctgcttctactctttcttnacagaaaaagtggattgtgttcatataggaaagcagttcacagactgtcttcctgcccctcccgccaccaagctggacctagaatcaagtgtgactttaaatggggaaagctgtgttacagttgtgcttaagccactgctgtggcttaacctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctccaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297041 - DNA, 903 bp, Homo sapiens
  misc_feature (212)..(212): n is a, c, g, or t
  misc_feature (232)..(232): n is a, c, g, or t
aggacatggctgtagaagtacttttcctcctcctttttgtttttttttgagacagagtcttacctgttgcccaggctggagtgcagtgacacaatcaaggctcactgtagcttcaacctccggggaacaagcaatcctcccacctcagccttctgagtagctgcgactacaggcataagcccccatacccagcttttttttttgccgggggnagggtgggcgtagagatggnatcctcactatgttgctcaggccggtcttgaactcctgggctcaagccattctcccacattgtcttcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctccaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297042 - DNA, 1791 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatgggagcaagatggccatcagatgtacttagtacctcattacataagtaaatattctgtaaactggtgaagagcgggtacaaacaaagatgtcatgtccatgaagtcaagttaaatgctttagaaatttagctgttgaattggtgttaataagctgagattaggcaaggaaaagtaaaagcagagggttgttcagcatattctttgagagctcattccaccataagtaaacaaaaatggaaaccacaaacgattccccatgggtgtgttttctcgctagaaaccctgtgatatgatttggatgtttgtcctcttcaaatctcatgttgaaatgtgctttccaatttggatatgagggggccctgatggtagcaagactgcggtgtatcctctagagtcagccaga

SEQ ID NO: 297043 - DNA, 1386 bp, Homo sapiens
  misc_feature (1370)..(1370): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggtgcctgctacgnggatcctgcagagtca

SEQ ID NO: 297044 - DNA, 2933 bp, Homo sapiens
  misc_feature (2074)..(2074): n is a, c, g, or t
  misc_feature (2094)..(2094): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcctgggcaataagagtgaactctgtctcaaaaaaaaaaaaaccctgagtctctcaaaatttgttaggttaattattgcttcacatgtggtcacggtttgaaaacttattttggggggagtataaagtagaatacagagattccttgctcatagctcctactgctatcgggaacaatccttgagggtgagaacgtggattgattcttgattgatagtggggattccattatctgtatttggcagttatggcctgctgcggtgtatagaagcttctttccattcattttcccgaattttcatactgctcaaggaacagttgggggggaatgggcagaaggttgggcacttgagtatttgagctatcggtaataactgactttttagggagcacagatttgagtagagccatggtagtagttagtaccaatgggttttngctgcttctactctttcttnacagaaaaagtggattgtgttcatataggaaagcagttcacagactgtcttcctgcccctcccgccaccaagctggacctagaatcaagtgtgactttaaatggggaaagctgtgttacagttgtgcttaagccactgctgtggcttaacctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctccaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctgagcaaccaagcaaggccctttttaa

SEQ ID NO: 297045 - DNA, 445 bp, Homo sapiens
cgagctcggcacccgtacccaggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaggggggcgacaccaagagccg

SEQ ID NO: 297046 - DNA, 562 bp, Homo sapiens
  misc_feature (18)..(18): n is a, c, g, or t
  misc_feature (30)..(30): n is a, c, g, or t
cgacaggctgcgagaagncgacagaagggntcacagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297047 - DNA, 772 bp, Homo sapiens
  misc_feature (27)..(27): n is a, c, g, or t
aggggagtggacaaacatcggctaggncgaggctggagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataatcttttcaccataaaaaaaaaaaaaaaaaaaaaacgggggggtcaagggcggggggcgggaaaaagggggtaaggacaggggccagggggcaaagcgggtgcccggaccaagtttccgggtgcaagcgggggacaatgggcgggccccctataggggaggggaaataattccgaaagccggggtaccggatagatacgggcagaaac

SEQ ID NO: 297048 - DNA, 460 bp, Homo sapiens
gagagagagagagagagagagagagagacactgcgactccggagggtgggtgacgtgccttcggccgccggaaggtgggtgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297049 - DNA, 529 bp, Homo sapiens
  misc_feature (15)..(15): n is a, c, g, or t
atttcggaacgagcngcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297050 - DNA, 1933 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggactt

SEQ ID NO: 297051 - DNA, 1967 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaggggggcgacaccaagagccg

SEQ ID NO: 297052 - DNA, 2543 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaaaaaaaaaaaaaaaaaaaaaaaacaaaagaaaaaaaagaaaacaagggggcgcgcgcgcgccactaaaaagatctccccacagaggggccagccaaggttagacggcgtacccgagctagtctgttcacacacaaggggggccccaactagaagagaaccgcgcatatagtacagcgaagaggcagggcgcgcagagtacaaccagcacgccgctcgcacgcgcggagacacacactgcgtcgaccgccgctggggacacccacgtgtgtggagaagcgacaccacaaacgacagcggcgaggggcagggaacccaataatagctggcggccagacaacaccctcaccctcacacgaggaggtaagttaaaacggcacacctaaagagggcgaacaacaaataaaaaagcctagcacgacgcgcgtctactaacactggtgctgtgcacgaaacacacaccgccgacgacaaaactacgacctggcgaagccgagacaaaaaaaaatgcggcggacacccacagggacgttataatagcggaaagcagaaatactaaaccccgcaggggcagcgtggctactcaataaacggaggag

SEQ ID NO: 297053 - DNA, 443 bp, Homo sapiens
  misc_feature (18)..(18): n is a, c, g, or t
acccgtagcagcgcagcnacatcaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 297054 - DNA, 1728 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataatcttttcaccataaaaaaaaaaaaaaaaaaaaaacgggggggtcaagggcggggggcgggaaaaagggggtaaggacaggggccagggggcaaagcgggtgcccggaccaagtttccgggtgcaagcgggggacaatgggcgggccccctataggggaggggaaataattccgaaagccggggtaccggatagatacgggcagaaac

SEQ ID NO: 297055 - DNA, 1576 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaacaagacacatgtagggctgatttgcccaataagccctttaaagaaattcttgt

SEQ ID NO: 297056 - DNA, 1557 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatacaagcaaattagtataagttcacaattccttgtcgcc

SEQ ID NO: 297057 - DNA, 1911 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaactatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaggggggcgacaccaagagccg

SEQ ID NO: 297058 - DNA, 1424 bp, Homo sapiens
  misc_feature (1389)..(1389): n is a, c, g, or t
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatgnagagggagcagcagaggatcctctagatcacccag

SEQ ID NO: 297059 - DNA, 1596 bp, Homo sapiens
ccctcgtgactcgattatttatttatttatttatttatttattttgagacagggtctcactctgccacccaggctggaatggctcattgcagcctcgacctccagggctgaagcgatcctcccacctcagcctcccaaggaactgggactacaggcacgcaccaccacgcccggctaatttttgtattcttttgtagagacagggtttcgccgtgttgcccagggtggtctcgaactcctgggctcgaagcaattcgtccacctcggcctcacaaagtgctgggattacaggcgtgagtcaccgcgcccggccctgacttgatttttttctgccaccaaatcactgtgttattgataaaccacattcctctctggacctcagttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccccagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctgagcaaccaagcaaggccctttttaa

SEQ ID NO: 297060 - DNA, 2090 bp, Homo sapiens
  misc_feature (4)..(4): n is a, c, g, or t
  misc_feature (6)..(6): n is a, c, g, or t
gggngngagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggagctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297061 - DNA, 736 bp, Homo sapiens
  misc_feature (4)..(4): n is a, c, g, or t
  misc_feature (6)..(6): n is a, c, g, or t
gggngngagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaa

SEQ ID NO: 297062 - DNA, 537 bp, Homo sapiens
  misc_feature (4)..(4): n is a, c, g, or t
  misc_feature (6)..(6): n is a, c, g, or t
gggngngagggccggcctggacccggcgggcgcacggctccgagcccagcgcagccgagccggtctgcagaggggcccccagaactttgtgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaa

SEQ ID NO: 297063 - DNA, 452 bp, Homo sapiens
ggctcgcggagaataaaggagcgtggggtgggcgcggaaagaaatgggaaggggcgcggggcggagagcgaagtggaaaggaggtgctccgaaaggagacatatactgcctggactgcctggctgatgtgagctagtttgtctggttgagttggatgtttaaatagaaggcagaacaacaacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaa

SEQ ID NO: 297064 - DNA, 2034 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297065 - DNA, 1970 bp, Homo sapiens
tggcatcctggtcctctcacatggctccttaaaattggctgtggcttgttttttgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297066 - DNA, 2404 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaataaaaaaaaaaaaaattttattttttttttatatttataaaaaaaatattttaaacattttcttctttaaaaaattttaaaaatttatatgtttcggcgcctttccccctttttttttttacaactcactttttttccgccggcctaaaatatgggcactttcggcataccccctctttggcggatgaataacctttcggggcccgtttttaaaacagtgggggcgaacgtgattctaaaggagtgtcccctcctaaaccctctcaaacatattccccaa

SEQ ID NO: 297067 - DNA, 2077 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaaattgccaatggggtttgaaccagtgctctctctaaatgaagaa

SEQ ID NO: 297068 - DNA, 1871 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297069 - DNA, 1914 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaaattgccaatggggtttgaaccagtgctctctctaaatgaagaa

SEQ ID NO: 297070 - DNA, 1807 bp, Homo sapiens
tggcatcctggtcctctcacatggctccttaaaattggctgtggcttgttttttgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297071 - DNA, 2194 bp, Homo sapiens
  misc_feature (4)..(4): n is a, c, g, or t
  misc_feature (6)..(6): n is a, c, g, or t
gggngngagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297072 - DNA, 2194 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacgtgagtacaagttggatccagttacccatgggatatccataggacaattgattttgtgtttgtgggagtgaaacttatttttaatgacttgctaatatcacattctaagcttataagatgaaatagggtcattgcttggcttctcctgctctccgggttagcaagcgaaatgaaatgttgagaacaataaccacaacaaaaagacaaattgtgtgtgcaccttcactgtctggggtagtccatgaagccaggcctggctcgaggaagctgtggaagcccaggaaggtgtcaggcccaaagggcagggatggggaaggagtcatggcttcccaatatctgacttggagctgccacacggagggaggcaggtgtgagccagaaaggagagccaagatagaaggcaggagtggacaaaaggacaggccaagctgaagctggactgaagactggaagctgaggaggaggctcacaaatggaataagggaagatggggcccgtcagcgcccaggccagcttcagggcattttcttctagatgaggcccctcttgatcgcttatagcagatataacgagggtgctgagcaaggctactttatcacctcattttttcctctagatgcttgtgtgtgtataactttgactcatgagttgtcaaagagattcatttttaaaatctgtactttaaaaggaagaccaccacagtggaatcctttctgttacattctgatatgattgctattacattcaccattttgaaaggtggtctgttctgttactggaaccattaaaaaatgtttcatacaatgaactgaaaaccacttc

SEQ ID NO: 297073 - DNA, 2063 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtaagaaggaaactcaacgtttctattatgtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 297074 - DNA, 1171 bp, Homo sapiens
ggctcgcggagaataaaggagcgtggggtgggcgcggaaagaaatgggaaggggcgcggggcggagagcgaagtggaaaggaggtgctccgaaaggagacatatactgcctggactgcctggctgatgtgagctagtttgtctggttgagttggatgtttaaatagaaggcagaacaacaacagggtcttgctctgttgcccaggctggagtgcacttgcagtagcataatcacaattcactgcagcctcaacctcccaggctcaatcattcttcctgcctcagcccccaaagtagctgggactacaggcatgcaccaccatggctggctaagttttaaaacttttttgtagagacatggtctctctgtgttgcccaggctggtctaggactcctgggctcaagcaatcctcccacctcagcctcccaaagtgctgagattacaggtgcaaactatctcacccagcctttaatctttttattagtgagatatctgacccaacggctaggatctgatggtctttttagtatggcctcaaatcactgtatcctgtaagcatttttttttttttttgagctggagtctctgttgcccaggctggagtgcaatggcacaatctcagctcactgcaacttctgcctcctggattcaagtgattctcctgcctcagcctcccgagtagctgggatcacaggtgcctgccaccacacccggctaatttttgcatttttactagggatgcggttttgccatgttggccaggctggtcttaaactcctgacctcaagtgatctcccctcctcggcctcccaaagtgctgggattacaggcgtgagccaccgcacccggcctaaacatattttcttctagagtgtttttaggtctgcacacggagtcctaggtcaatgccaacaccaactcacactgagccctaactatggaatcggagcaacatcattatttaggcccatggacaaaataccaaagtaatctgtttctatgttccattatttcctcctctccatacattatacatacaacaatttccctttatcacacgtacctgtgactacgtgggaatcattctatcccaaattgctgcagcacaatctgaggcttactaaatatttgcctcagccataaagctgatagagcattagtttaaaatgca

SEQ ID NO: 297075 - DNA, 509 bp, Homo sapiens
cagcatgaagctgctttccccagagcccctgggccagagggcattgctcagttactggccagaactggagagtgagatggggaggatcagcagggacggctggagtcactgaaagataggtttggggctttgctctctgctttcttcttgtgtgaccttggacaacggacttggccttcttgaacctccaagtcttcatttgtacagtgagatgctactatctctttgacaaatattttaattttctctattttaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttg

SEQ ID NO: 297076 - DNA, 571 bp, Homo sapiens
gcgtggtggcgcgcgcctgtagtcccagctactcgggaggctgaggcaggggaatcgcttgaacccaggagtcggaggttgcagtaagccgagattgcaccactgcactccagcctggcaacagagcaagactcaaaataaataaataaaataaaataaaataaaatgagtcaggaatgatgttggtgttgaggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgatccaagaaagaaggcatatgcagatttctgcagaaattatgagattttgagcagatgaggaaggctggtatctttcagtttaaagtaatcttggaatataaagaatttcttcaggttgaattacctagaagtttgtcactgacttgtgttcctgaactatgacacatgaatatgtgggctaagaaatagttcctcttgataaataatcaattaacaaata

SEQ ID NO: 297077 - DNA, 548 bp, Homo sapiens
cccgacactgcgggttgtcacaacggcaccctcccgctttctctctgcctcggatttagtcgtgactgtgtgtcttcgccgtggtgcagcttcaggcctctcccgcatctactctctcacgcttccgctgcggcctgagggagggcggcgggcggaccacgggaccgggggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgatccaagaaagaaggcatatgcagatttctgcagaaattatgagattttgagcagatgaggaaggctggtatctttcagtttaaagtaatcttggaatataaagaatttcttcaggttgaattacctagaagtttgtcactgacttgtgttcctgaactatgacacatgaatatgtgggctaagaaatagttcctcttgataaataatcaattaacaaata

SEQ ID NO: 297078 - DNA, 981 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297079 - DNA, 2387 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcgaggtgaggcccgcgccgtcagggctccacagcagaccgggctcctcttgtgaccggcgtctctcctttgcctcctagagaatctcgatgctggcctggagcagaaactgagctggaccactggagcctcggtgaggggtctgtaccccacctgggaaaggcagtgggtggctggggctatgtggacagggaggccggaggtatctagaactgccatgtggtgtctgcaaggctctgtccagccaggtttcaaccgtacctgtcactctgccacccccgcgccccaggtgagccccggagtccaggtaaggctccgcgatgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgtgagtcacccacctctgaccccaggctagcctttgacctgaccttccaacacctcctcctgacaagctgtcaccctatagcctttcagattgcataggccgagctcacacaagtcagcatccctgaccacattctctttatcttgcaccttgcaaggggtgtagaacttttctcttaacccatcccttctctcccaggcacttggatccccattagagagttaggatataatcagagtcaccatttatggaatgtttatgtgccttgcactgttgtgtgcctggcgtctattatctcattcaatcattgcagtgatcctctaggtagaagctattattatctctacagaagaagacagggaggcccagagatgttaggtaacttgcccaagatcacccaactggtaagtaacagaatagggaccagaatctgagttggttggttggtttttttttttcactccaaacccttggtcaccagcttatattgtcatttagagtatcagaaaaattgccccagactctgcaacaacatggagcttgggttcaccagcctccctttccatagtcctcattgccactgctgctgtccagggtctgatttcactaccctgagtctcatttccttatctctcagtggaagataaagccactgcctagcacccaggattgttacagggatcagattagatgctcaggaagatgctcttgggacactgcaagggacaggattcttcaggcgtcgcttggaactgtggtgcctctgtgaggtggatgtcccaggcagagccagccagccagccctgacctgagctcgctgctgaccctgccacagattggctgtgtgtctctggacaggtggcttggccactctggacctctaccaaataaagagctggccggccaggcacagtggctcacacctgtaatcccagcactttgggaggccgaggcgggtggatcacaaggtcaggagattgagaccatcctggctaacacggtgaaaccccatctctaccaaaaatacaaaaaaaaaaa

SEQ ID NO: 297080 - DNA, 275 bp, Homo sapiens
gagctcggtacccgcgtgggttccttgcagagcgtgggttgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgcaagacccacgcggggtcctctagatcgaccagcagcat

SEQ ID NO: 297081 - DNA, 641 bp, Homo sapiens
agaatctgtttacagcttatgaccaggaaattgagtctttgaagaggaacttagctgtcccaacagaggcatccgagaggcctggaggaggtgatgctggacagtaggaattgcctggtccgacgccctggctgccaggggcgcgcatctttgggtcttccctgctagaaggtgaactgagtgtgtccctggcgctctggcaaaagccatggaatgggcccacagtgagaattccagcttcgcctcttactagctggataacctagggagccgcgagacctccctgggcctcagcccccggtacagtggagccaacgggagaaacggcctcacgggattgatgcggggattgagcggggcacgggcggcggacaaacgcgggtcattatactcatctcccccagagcatgcgtcccagcgccacccgcttcctcgctccgcgcccggcctagaccctccgaccccgcccctgcgcgggccacaagcaggaatgcgagcaggcctggggcgcgcgggccgcagccgcatttccgggccggcgggagcgggcggcgggggaggggcggtcggggcctgcgccggccgccgtgtgacgcgccccctcatttgcatgcggagcgcccattggccacggcggccgc

SEQ ID NO: 297082 - DNA, 529 bp, Homo sapiens
ctggcagaagatggtgactggagtggccagagccccgtccccccgataccactgagctcactgcccctgatgccgagctttcaaggataggctttattctgccagccataccaatcataaatctactctgccagggacccgacttcgctccgccccgcacttggatccccattagagagttaggatataatcagagtcaccatttatggaatgtttatgtgccttgcactgttgtgtgcctggcgtctattatctcattcaatcattgcagtgatcctctaggtagaagctattattatctctacagaagaagacagggaggcccagagatgttaggtaacttgcccaagatcacccaactggtaagtaacagaatagggaccagaatctgagttggttggttggtttttttttttcactccaaacccttggtcaccagcttatattgtcatttagagtatcagaaaaattgccccagactctgcaacaacaagacccacgcggggtcctctagatcgaccagcagcat

SEQ ID NO: 297083 - DNA, 1118 bp, Homo sapiens
agaatctgtttacagcttatgaccaggaaattgagtctttgaagaggaacttagctgtcccaacagaggcatccgagaggcctggaggaggtgatgctggacagtaggaattgcctggtccgacgccctggctgccaggggcgcgcatctttgggtcttccctgctagaaggtgaactgagtgtgtccctggcgctctggcaaaagccatggaatgggcccacagtgagaattccagcttcgcctcttactagctggataacctagggagccgcgagacctccctgggcctcagcccccggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297084 - DNA, 989 bp, Homo sapiens
agaatctgtttacagcttatgaccaggaaattgagtctttgaagaggaacttagctgtcccaacagaggcatccgagaggcctggaggaggtgatgctggacagtaggaattgcctggtccgacgccctggctgccaggggcgcgcatctttgggtcttccctgctagaaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297085 - DNA, 773 bp, Homo sapiens
ttcggcacgagccacgacgacctcatctccaagtccttccagggcagtcaggggcgtgcctacctcttcaactcagtgtgagtatctggcctcccttcttgctttccctgacctctgttgtgacctgtgacccctggcatcctgctgagactcccagagttccccggtgcaggcaggaaattggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297086 - DNA, 2592 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcgaggtgaggcccgcgccgtcagggctccacagcagaccgggctcctcttgtgaccggcgtctctcctttgcctcctagagaatctcgatgctggcctggagcagaaactgagctggaccactggagcctcggtgaggggtctgtaccccacctgggaaaggcagtgggtggctggggctatgtggacagggaggccggaggtatctagaactgccatgtggtgtctgcaaggctctgtccagccaggtttcaaccgtacctgtcactctgccacccccgcgccccaggtgagccccggagtccaggtaaggctccgcgatgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtgtgagtatctggcctcccttcttgctttccctgacctctgttgtgacctgtgacccctggcatcctgctgagactcccagagttccccggtgcaggcaggaaattgtgagcatcatttcttggatgctgaggacagacacagtgcttgagggggtgggccctgtgatggcaggaccctccctgggactaccccatgtccccacagggtgaacgtgggctgcgggccagccgaggagcgggtgctgctgaccggcctccatgctgtcgccgacatccactgcgagaactgcaagaccactttgggctggaaatatgtgagtcacccacctctgaccccaggctagcctttgacctgaccttccaacacctcctcctgacaagctgtcaccctatagcctttcagattgcataggccgagctcacacaagtcagcatccctgaccacattctctttatcttgcaccttgcaaggggtgtagaacttttctcttaacccatcccttctctcccaggcacttggatccccattagagagttaggatataatcagagtcaccatttatggaatgtttatgtgccttgcactgttgtgtgcctggcgtctattatctcattcaatcattgcagtgatcctctaggtagaagctattattatctctacagaagaagacagggaggcccagagatgttaggtaacttgcccaagatcacccaactggtaagtaacagaatagggaccagaatctgagttggttggttggtttttttttttcactccaaacccttggtcaccagcttatattgtcatttagagtatcagaaaaattgccccagactctgcaacaacatggagcttgggttcaccagcctccctttccatagtcctcattgccactgctgctgtccagggtctgatttcactaccctgagtctcatttccttatctctcagtggaagataaagccactgcctagcacccaggattgttacagggatcagattagatgctcaggaagatgctcttgggacactgcaagggacaggattcttcaggcgtcgcttggaactgtggtgcctctgtgaggtggatgtcccaggcagagccagccagccagccctgacctgagctcgctgctgaccctgccacagattggctgtgtgtctctggacaggtggcttggccactctggacctctaccaaataaagagctggccggccaggcacagtggctcacacctgtaatcccagcactttgggaggccgaggcgggtggatcacaaggtcaggagattgagaccatcctggctaacacggtgaaaccccatctctaccaaaaatacaaaaaaaaaaa

SEQ ID NO: 297087 - DNA, 476 bp, Homo sapiens
tgattagaggatcccctggctgggaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297088 - DNA, 926 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgcaagacccacgcggggtcctctagatcgaccagcagcat

SEQ ID NO: 297089 - DNA, 932 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297090 - DNA, 886 bp, Homo sapiens
  misc_feature (326)..(326): n is a, c, g, or t
  misc_feature (563)..(563): n is a, c, g, or t
  misc_feature (592)..(592): n is a, c, g, or t
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgagaataattggatgattgtaaaaggaggtatagatgtgaaaaatgaagagataaaatggaaaaaaaagaagaaataatataaaagtaattaaagggaagtaaggggagtgaataaatattaaaataagtggtgaaagtgggatgagggaaagaagaggagagggngatgatgaaaggaataaatgtgtagaagaaataaaatgagagaaatgaaagaaaaatttgggatggaaatatgaaaaggaatttgagagaagaaagaagtaaaaagaggggaagtaaataattgaaataaaaaaaatgataaaagaaaaaggatgggaatgaaaaaagataaaaagaagaatgtggataaagaaaggaatggaagaaagggagagaaaatggattaaagaagagaangaagggaggtatggaaaataagagaaaangaaggcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297091 - DNA, 867 bp, Homo sapiens
ccccccactcccaggccagcccaccccggcggaccgggccccgcgcgcccaggcgaggcgaggtgaggcccgcgccgtcagggctgcgtgtcgccccgcgcccctgcccagcccgcgaggactgccccctcccccggcgcccgcccccacccccgcgccccaggtgagccccggagtccaggtaaggctccgcgatgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactg

SEQ ID NO: 297092 - DNA, 682 bp, Homo sapiens
tgcaggctggtacggtccgaagtcgtatgatcgacctcatctccaattccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297093 - DNA, 1831 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcgaggtgaggcccgcgccgtcagggctccacagcagaccgggctcctcttgtgaccggcgtctctcctttgcctcctagagaatctcgatgctggcctggagcagaaactgagctggaccactggagcctcggtgaggggtctgtaccccacctgggaaaggcagtgggtggctggggctatgtggacagggaggccggaggtatctagaactgccatgtggtgtctgcaaggctctgtccagccaggtttcaaccgtacctgtcactctgccacccccgcgccccaggtgagccccggagtccaggtaaggctccgcgatgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297094 - DNA, 1059 bp, Homo sapiens
  misc_feature (340)..(340): n is a, c, g, or t
  misc_feature (378)..(378): n is a, c, g, or t
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggagcagcccaatggctgaggtgactggagctcctctctgcatccccgttgtgtccggctcaccgctgcgttgggtgccatcttgcctcgctcggtctcccgtgcaatggttgcaggaatttcaacatgcacaaacgactgtttcaatagccatatgattgtgactcgagtatgatcnaccgagaaggtgtgtacgcatgatgtccctaacgtgancgtggcctcaacgttgacaaaccatgatggatgctcgtctcaaagtccttccaggatctccttggacgtgtgttacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297095 - DNA, 1922 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcgaggtgaggcccgcgccgtcagggctccacagcagaccgggctcctcttgtgaccggcgtctctcctttgcctcctagagaatctcgatgctggcctggagcagaaactgagctggaccactggagcctcggtgaggggtctgtaccccacctgggaaaggcagtgggtggctggggctatgtggacagggaggccggaggtatctagaactgccatgtggtgtctgcaaggctctgtccagccaggtttcaaccgtacctgtcactctgccacccccgcgccccaggtgagccccggagtccaggtaaggctccgcgatgcaggtaagagcccctgagcgtagaggaggccttggcgcccgcaggtgagagcccctcccctcctaggtgaccctcaaccttcacggcgaggcctcctacctcctccaggtgggggaccctctccccgatgaaccccctaaaccaccagtgaaccccactgctctccagatgaggtcgcaaggaccaaccagtgcctacccgcccatgctcccccgaaactgggaactgacagcccagcccctccaaagccccttcctccagcttcagctgccaggtcagcaagggtgaggccggaagcaggcgggtgactcaccctgggcacctccgagcctcagtttccccatggatgcaacctgaggcctcctcactgagtcaaaaccgagacgcctctggtccccggagaggctgctggctctggggaaaggagagagcagcccagtgtgacagagcgagtccccacggctctgggagtgcctcgcatgtgtgtggcccaggtcctgacagcccacctactccctccccggcaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatattgatcctctaggtagaagctattattatctctacagaagaagacagggaggcccagagatgttaggtaacttgcccaagatcacccaactggaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtgga

SEQ ID NO: 297096 - DNA, 1005 bp, Homo sapiens
gtcccctccccctcccgccgcagcggcggcagcagctgggctcggtgtaaacaagtccaggcgcctgcgaacccgggcccgggggggacggcgcccgccaggagcgccccccactcccaggccagcccaccccggcggaccgggccccgcgcgcccaggcgaggcactgggctccctctgctccccgtgggccgctccccgcgtggggccactgcccccggcccccgccatggtgcggatttcaaagcccaagacgtttcaggcctacttggatgattgtcaccggaggtatagctgtgcccactgccgcgctcacctggccaaccacgacgacctcatctccaagtccttccagggcagtcaggggcgtgcctacctcttcaactcagtggtgaacgtgggctgcgggccagccgaggagcgggtgctgctgaccggcctccatgctgtcgccgacatccactgcgagaactgcaagaccactttgggctggaaatatgaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggaaaaaaccaaaacaactcaacacaa

SEQ ID NO: 297097 - DNA, 591 bp, Homo sapiens
agccgacgcctagaggaccccgtggttcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297098 - DNA, 504 bp, Homo sapiens
tttttttttgtgacagagtctcgcttcgtcacccaggctggagtacagtggctcaatctcagctcactgcaacctccacctcccaggttcaagcaattctgcctcaccctcccgagtagctgggactacagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgatattttagatgcattgtctcatttgctcctgacatcaaccctgtgagaatgagatgctggaggaaggacatgagtatgcggtcatgctgtacacctggcgcagctgttcccgggccattcccaggtgagactgtccttgttg

SEQ ID NO: 297099 - DNA, 223 bp, Homo sapiens
aagtcttagttcttccttccccagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtactggtgcggaccatgcttgaatcaccaccagaatcttccagtaccg

SEQ ID NO: 297100 - DNA, 4301 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297101 - DNA, 4287 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaggtttaaaaaaaaaaaaaaaaaaaaaaaaaaaaaaaaaaaaaaaaaaaagaacaaagggggggggggggcccaaaaaaaaaaacgaataaaaggagaaaaaaaaagaacgccttgggggggggcccggaccccaattccccctaaaggggggggattta

SEQ ID NO: 297102 - DNA, 4452 bp, Homo sapiens
atcaggctaggtagcgaggctgggtggttgtagagttaaggaagggcctcttcctctgtgagaattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297103 - DNA, 4466 bp, Homo sapiens
  misc_feature (13)..(13): n is a, c, g, or t
  misc_feature (17)..(17): n is a, c, g, or t
  misc_feature (35)..(35): n is a, c, g, or t
tcgacggcagtantcanggcgttatgtaggaggcngggtggcggtagagttaaggaagggcctcttcctctgtgagaattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297104 - DNA, 4376 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297105 - DNA, 4765 bp, Homo sapiens
agcagcggggccggggcggggccgagcgcggcgcagcggagcggggcagagcatcctgcgccccggcgcggggccctgcggtagcctcaggcccctcccctggacccgccgcagagccaggtaagcggccctcgcaggcctcgggccgggcacggggactaggatgccgccggggacggggatgaggccgtgaggatgcgcgaagggccgccccctctcccggcccgcggggggcgctcggcgctgtgcccgggctagcccgaggcccggcctcaggccccacgcggcccctttccccctcggacccaccgtgcgtcccgcggcacggaccctctgcccgggaggcgcgggcacatcgcggagctccggcgcggcggcgggggagccgcagcagcaggtgcgcggcctgggccggagccgccagcccgggaggaggcggtgctaatctcagggaccggagacacctgcagcggccgcgagcccggcagcggcgacatcctcgagtccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297106 - DNA, 4355 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccgcgtcacgcatcggctgctctgtaagcatatgacgctggacagcttcgatgccatgctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297107 - DNA, 4017 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297108 - DNA, 2074 bp, Homo sapiens
cggctaggtaagcgaggcgggggtgaatcggccgaggcagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297109 - DNA, 3964 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgccctgacgaagatggcgaccggcacccagggaagtattaggaatctctggaacaaacgagagcgtatctgagccaatgcatggaacaaacatacattagaaggaccaggtggagagcagacccgccacccctgtgtggagccatatggtgcagcaggggcacaagcacacccatagagccagaacactgtggcccccacagtaggtaagaagcaaaaagaccagcag

SEQ ID NO: 297110 - DNA, 3863 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagtgagtaccccccagagaaggcagggttacccccaacctgcctgtgctcctgcaagtcatggggctgccagagttcagccagaaacgtgggcagggggtgggggtggttggccaacaactactttgttgagtgtgttgagctgactgcattggcaagaaagagcccagtaagggtttgatagtaagaccctcactgcctgcctcacccccactacactgtactactggaaaatgaggagcctttaggagtccttagagcagacagcagagctag

SEQ ID NO: 297111 - DNA, 1546 bp, Homo sapiens
accacgcgtcggactagttctagatcgcgagcggcgccctttttacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297112 - DNA, 1468 bp, Homo sapiens
cgctacaagggtcagtggattacaggcaacccccaggaggggaccttaaagatggaatgggcaggacctggtgactgccgtggagagaaagaaaacagactcatggctcaggccaagattagtaagaaatacaggcctccctgcctgctgtgcccccatacagtgctcaagcatgttccggcatcagccccggacagaggattgggaggcctgggttctcagcccaacatggcttcagacacattcctcaacttccctgagcctcagtttcttctgaaaagtggggctgctgacccatgtgcctgaggctgttgtgagtcttcgtttcgggcactcagtaaagtggggccaagtcttgtggaacttgaatatcagccctttaactgccccacctaggcaggaaggagggaagcaaccagggagcaaggactgccttccagaagtgggcggggccttgtacgcgtacaaggccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297113 - DNA, 1019 bp, Homo sapiens
  misc_feature (32)..(32): n is a, c, g, or t
  misc_feature (70)..(70): n is a, c, g, or t
ggtctccacccctcaagccaggagaccctgtntttgctgtttatatatatatatattatatataaatatntatttatctgtctgagccctgccctcactccactcccctcatccactaggtgcccagtcttgagtgggccccctctcttaccccgtccctttccctgcatcccttggcccctctctgtttaccctccctgtcccctgaggtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297114 - DNA, 758 bp, Homo sapiens
  misc_feature (11)..(11): n is a, c, g, or t
gaaaaaaaaangtaaacagggcagtttgtgctttttcttttctcccccctcaactatattaagactcctagtttcaccctttctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297115 - DNA, 1366 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtaaaactcccctgaggccgcacccatggagcctgggcttaccctctcaccttcttcttattaaaaatccgttttaaaaaacaatgtttcttttttcttaaacattgatacagatcttacggcacataatggtttgtaacctgttcctttcctgtaatataatataccgtagtcacctttccagatgtcattaaggctatttctacaatgttatgtgtaatgactgccaagtattctgttgtattggaacattgtcatgtaacatatcccctgtggttggatatttgtttgctaaacttcattgaacacccttgtagcagtttttgtgcacatctttttgtcaaggcaaacttcctagaagagaaattgctggctcaaagggaaaaacagaataaatctttttttttatttcaatagtttttggggaa

SEQ ID NO: 297116 - DNA, 688 bp, Homo sapiens
ggtcaaagcgacgctgcgtggcccagcaggacaatgagtggagcaaccagccctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaag

SEQ ID NO: 297117 - DNA, 1052 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccaggtgagggcagactccttgttaggcctggcctgatgtctcggggttataggcaggcgtgtagaggttgggtggaccacgagcccaagcagacaagctcagtctgcagcttccatctccactgccctacttgagagtgaaatgtagctgaggacttaagtctgtcctcccaaccccaggtggccgattcaccctctccagttgtcatgctcgtgaagccctctcagccagtgctctgaccctgca

SEQ ID NO: 297118 - DNA, 772 bp, Homo sapiens
agcagcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttgctgcggaagatggcagatccgcgatgcgtcggggctaatctagaggg

SEQ ID NO: 297119 - DNA, 453 bp, Homo sapiens
  misc_feature (13)..(13): n is a, c, g, or t
  misc_feature (17)..(17): n is a, c, g, or t
  misc_feature (35)..(35): n is a, c, g, or t
tcgacggcagtantcanggcgttatgtaggaggcngggtggcggtagagttaaggaagggcctcttcctctgtgagaattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtacacaaaatggacaatgttgacatgctgaacacatcagcccccacagccaaccccccaactctgctccattcctgccactcaagggaagagatgaacatgcaagcaataatatcacacagagatcttgaaccctcgcctcacatacaataaaatgtaccttgtttgc

SEQ ID NO: 297120 - DNA, 234 bp, Homo sapiens
accatgagtatgacacctgatgctccccaggtggtgacgggctcagggctggacagccagaagtcagacgaggagtatcgcgagctcttcgacctagccctgcggggtctgcagcttctatccaagtggagcgcccacgtcatggaggtggtaggtgtctctgggtagagggcctcacactgacctctctttccttggaatctgcctccatctccccctagcactctcttttta

SEQ ID NO: 297121 - DNA, 502 bp, Homo sapiens
atagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccacctcagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtgggagtgccaggaaacaaagcagtctcagccaaaaatgc

SEQ ID NO: 297122 - DNA, 1344 bp, Homo sapiens
agttctatgagaagccaaatggtgctcgcaattgtgcttgctgctggactggcaagcttcatgttatgtttatttggtgtgcgtgtgtctttattattttgtgtaaactatattctgcttatagagagtctctgagactaaaattgacaacttgaaaagtattccaaggaatattatgaaaatagggcaacatggactgtttaagatctccatgtaattgaaattcatgcaaggaaacaactcatagaaaagataaatatggatgcccttcacatgttatcaacctcgtaacttttggtgcttgctgaatcagtccatgaaaagctacagcccgctctttgggaatgctacatacccatttctggtatttaaaaaatatctaggaggagctaaatgacaaaacacagcagtgttttgagggagaaaggaccatcatttataatgctctgtacatactaccagagctgcttggaaaattaaaggccacttgtggctttttcctaccaactgatacgtttaaatttgccctaggattgagctaacagcaaaaaaaaaaaaaaaaaaagagagaaagaaaggagtaaacagtggtaataaaaaaatccatctgtcttcttgctatgttaatattaataaatcataatatgacaagaccctcactgaataagagtattttcagtcatcagaagccagctgttggtaggcattaatgagtttaaaattgttctcaattgaaaaaacatcacactattttgccaaaaccaaagtaattataatactgtgtcctcctgtaattttttgagaagtggttataaagggcatatttacataaattctactttattcctcaacttctttgatgaatgtaacccaattttacttctttaaaaagtctcaattcaagctggattagccagctcagcataatcaactagacagtggtttgttaaatttagcagcatacttcgttcccattctaattaaagtcatgagttcttgaatcccagagaaataatgcttaggaacttctctcaatctgcttggcttggcctagagaagtggccattttatcaacaggaaaaaaaaaaattttctctactacaaccccgttgccttctgaaaaacagcaagttatttctttatataattatcattttattattttatggaaaattaatttattaattaatagcctattatgtgttctcacttgcttctctaagtaatattttgagataaaatgttgaataaaaccatggattatagagaaaagtcaaaatatatgtgtaatatttaattattttataagttttataataaagtattccatttctttatctttga

SEQ ID NO: 297123 - DNA, 428 bp, Homo sapiens
tgatttgtgtctgaattattcagacatctaactttgtagttgagctcatttcacaaatgtgaaatggcatgggaatttggagcaaacgcagcaaaagtgaactgacttaagacctaagaagtgtttgtatgcgtttgtggctgttgaaactgcttcctaggttttaattcttaccactacaggcactttacaaataggcttaatttccattctgattgttttcaacaggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaaggttagtgacttagggagctttgaagttaccagaaacactaaaaaaa

SEQ ID NO: 297124 - DNA, 4241 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagcatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataaaaaatggtgt

SEQ ID NO: 297125 - DNA, 4188 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagcatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataaaaaatggtgt

SEQ ID NO: 297126 - DNA, 4219 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagcatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtcctgtccccccttctcctcctgatccctctcacctgacctcacttccgggttttcttcttaatgtataaaaa

SEQ ID NO: 297127 - DNA, 1707 bp, Homo sapiens
actggttcccaggacttcatttgggtcttccttgtctccattggataaaccaacttaaataatatatcttttgttttcctaccaactcgtatatctatagagtttctgcatctctttttaaatcagtaaagtcccagaatgggctttccactagatcagcaatatggacactttcccattctgacataatataatatatctgcttgctgggctctaagcacatgaaataattttttcgagtgaaaacttgaccaacaaaaatgctcgattgactctcttgaatctttctaattctatccttatttgctagggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataaaaaatggtgt

SEQ ID NO: 297128 - DNA, 1813 bp, Homo sapiens
actggttcccaggacttcatttgggtcttccttgtctccattggataaaccaacttaaataatatatcttttgttttcctaccaactcgtatatctatagagtttctgcatctctttttaaatcagtaaagtcccagaatgggctttccactagatcagcaatatggacactttcccattctgacataatataatatatctgcttgctgggctctaagcacatgaaataattttttcgagtgaaaacttgaccaacaaaaatgctcgattgactctcttgaatctttctaattctatccttatttgctagggagcgttctccatcaccactgaccgggaaagtcaatcagctggaattaattcttcgacaactccagaccgaccttcggaaggtaatcaattggaagagcataatcagaactgtttctcttataaaatcagccccttataactactacagataaattgaaaagatcagtttatttctactctgaccaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataaaaaatggtgt

SEQ ID NO: 297129 - DNA, 2410 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagcatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggtaaggtggctggctgttcttctctggtcagcatttttcactgtagggattgactaagcaaatgtattttcctcccaaaggaaatgtattttctaaaaaagaataatctaaaaacatctttcttaaactctttaaatgttgatgtttatatttccctataaaattattctcttgatttttacataaaaaaaggaaa

SEQ ID NO: 297130 - DNA, 289 bp, Homo sapiens
tctttgttttgctccaaaacaaggcagtaactggtttgaaggggggaaaagattttatttagctattgcatttccacaaagaaacattgccttgcattgattactaacccttctttctgtgtgtgtttctcccctccccagaccagagggtggcatccttctgcaccctgacagatatgcagcatgggcaggacctggaaggggcccaagagctgcccttatgtgtagatccaggcagtggcaaagagttcatggacacaactgggtatgtgagcccctgtggacccct

SEQ ID NO: 297131 - DNA, 350 bp, Homo sapiens
taggaggaatgaatgtatcgatcagtctccatgactcagtttatttctactctgaccaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcagga

SEQ ID NO: 297132 - DNA, 4347 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagcatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggtaatcaattggaagagcataatcagaactgtttctcttataaaatcagccccttataactactacagataaattgaaaagatcagtttatttctactctgaccaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataaaaaatggtgt

SEQ ID NO: 297133 - DNA, 3502 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagcatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgaggctgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagac

SEQ ID NO: 297134 - DNA, 327 bp, Homo sapiens
  misc_feature (11)..(11): n is a, c, g, or t
ggtctagaggntccccatacgatgctcgacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccccaggctcctggaagacgatggtgacgatgtcatttcctatgtgccttttcctcagtagctgttgtctgttgtcccgcgcgcagaggctcctctaga

SEQ ID NO: 297135 - DNA, 3722 bp, Homo sapiens
gcgagtgcatgtgttaaaactcttctgccttgcagcccacatcttctagagctccctgtcttcatatgtactaaagggagacacaaccctatgtgttttttcccaaagcatgtctctagcaagagggtacatagaaatggaacatgaggctttttgtcactgattttatgataaccagttaatgtggaatctgctggttgtcttactacagctttctatctccggtgaaagccataaaaatttaggttaacttttaagctcatgtctatatatatgtgtgtaagctagcatatacatatggtgattgacaagtatagttaattttatatggatttaaaagcaagcaatttttatatctacagacgtactcttcacttatggtggcttttatcccgccacatatataaatatatatatatatagcaaacagccttgcaaatcatcggccagaaaagctgcagggcgttgcaatggccttttcctacctgtttgccacctgtggtgagggtgagcaggatgattgaactgctgcatatttcaaacctgttatcactggcagtgtgtcccaagagaagctgaccagattatgcattctactgttctctagcacaagtactcaccaaaaagccaaatttcccctttggagttggtgacttagtgtagtctgtggctgacctagaaagacacagagttatcaagagtttcccttcctagaagatgaatgttaccttttgtgttaggaggtagagaaaataaaaatagcttttttttccctagaattgctaattactcttaacaacaaattaaattcaaagcctgtccttgagaactggaaatgtaaaatcatggttcaagttttataccttagtgattcctcagtaggtgttactaggagttcactgaatgaacttaggagtgaaccttcgatgtgcttgattttcttttgtgccttagtttctctgaatagcagaggcatcaaattttggtggggaatgagaggagtattaggggaaagtttgaaaatagctctcctggagatggagggcacacagagtggtcctcaggctcaccttgactgagttgattcacagttatcctgcatcagaccattagatttctttagtgctatgattataatagggatttttgaatcaccaaaaacagtttttagatgtttatgttctttgttttactatcaatgttgtgctggttaagggagagaaaagttcaagaagatcttacatatttgaaaggaaattggtactcttgaaggctatgcaacatgagtctttgaacaagaattccttgctactttgattcattcatcaaatactgagtgcctgtgtgccaggcacaggtgaactctggggattcaggggtaactaaaacagattggaaccctgcccttgtgaagctttcagtctagaagggagacgtgaaacaaattttagcttcaaaagcaacatctatttttgcctgttagcatgcatttattttaaaagtcatattagagttacctggttccacttcagagcagactgggaaaatcaggcttacaatggaatcagatgctgtgggcctaaaacagctctttaaaaatctatttttttaggccaggtgcgttggctcacacctgtaatcccagcactttgggaggccaaggtgggtggatatgaggtcaggaggtcgagaccagcctggccaatatgatgaaaccttacctctactaaaaataaaaaattagccgggcatggtggcacatgcctgtagtcccagctactcgggaaactgaggcagaagaatcgcttgaacccgggaggcggaggttgcagtgagccgggatcacgtcactgtactccagcctgggcaagagtgagacaccgtctcaaaaaaaaaaaaaatttttttttaaatggaatcagagaaaccaacaaaatatgtaacatgtataaatgcctgaggagatcagttattgagaaatccatttacaatgctggaggagaggggatggccaggaaagaagtgcaacaaataaatggaagatgaccctaaaaatgcaccagtgacagtcagtcaatccatcagaccacctcacatgcagggtagaaacatggagtgtgcggcagcatcctcctcacatccctttgtgagcacggctgctccggaatactgaccatctgggctagcacgacttagcagagggttctgcaggatgtgctattttaaagcagctgggtgcaacttgtgaaaacgggaatctagagcagaacatgtaatcagcgatggctgggattggtggacaggattgacaggagtatttgaggctctaccaggcctgtctacaggacagcttcatcaaagggacattttttaacctgttattttaaatgccacatatatgttgtaatgctgaagcatacaggtagaatttctggatcgtaactactagtgacttctgaggtttacagttagaaaatgttctcaaaggtttatcagttatgtattgatgattggtaatctagaccctctggaggctgtagaatgtgaaaagatacagctgagctgacaagttttagggcactatcttctggaatgaaatcggccaagaaaatggttcaagggcatgggggttagagaatgtttcttttacctaaaaatgttaagccaactatggaagattggggtcgtgggggcatgaaatacaaaattatgataatttatacagaactaggtttctttatgttctgcaagaaggtttttattagctaatttggggaggggggcatgctgcagtattttttttcctgggaacatgcatttctgatgggaagttattttgtttacaagagttggttttacacacaaccctgaatgaatgtgtctatggcctaaaaatggtagacctgtatttccttcccgaggcaggctgattcgtttcctgattccttctgtctgagattacctgatgctgaccagacttatttttcctttcctgaatcttcacagctgagtttatggcacccatccaagaccttcccatttgaatgactagatttctattctatccccgatcatccttttgaaatagttctagtgataaactcagagaaattcaatatattgattgaattttattttttcgctttgtatctacaacagaaattgatttgttcatttttatttcaaatctcttcatggcaagttgggctaatggactttgcactcaagaaaggtttgtttaccagttttgtagccatgtttggcaaatcttagcaactagaaaccccgtcctttcttttccttctttatatgttcttgcagttactcttgtattgcaagattttctgactttaagctttgagactactgcatcttaaaagaagaactaggctgactggcaaaaagtcttgccagtggccctgtcactcccatgatgctttggttttgagagttgggaaaactctgagaacttaagggaaccaaactcaggaatcccaaaattggtggcattgtgccattcgtttaggggctgaacataggacctgtctgaaactgagtgagctagatgcatttgggtttgaatttttgtcacatactgaaatgtaagtcagccctaaataatcaaaacactttattttatttttctttttttaaataggaactttctgaagaaaaagtggtgtgtaaaacatttgatatttaagacaataaagtttttatca

SEQ ID NO: 297136 - DNA, 2984 bp, Homo sapiens
gcgagtgcatgtgttaaaactcttctgccttgcagcccacatcttctagagctccctgtcttcatatgtactaaagggagacacaaccctatgtgttttttcccaaagcatgtctctagcaagagggtacatagaaatggaacatgaggctttttgtcactgattttatgataaccagttaatgtggaatctgctggttgtcttactacagctttctatctccggtgaaagccataaaaatttaggttaacttttaagctcatgtctatatatatgtgtgtaagctagcatatacatatggtgattgacaagtatagttaattttatatggatttaaaagcaagcaatttttatatctacagacgtactcttcacttatggtggcttttatcccgccacatatataaatatatatatatatagcaaacagccttgcaaatcatcggccagaaaagctgcagggcgttgcaatggccttttcctacctgtttgccacctgtggtgagggtgagcaggatgattgaactgctgcatatttcaaacctgttatcactggcagtgtgtcccaagagaagctgaccagattatgcattctactgttctctagcacaagtactcaccaaaaagccaaatttcccctttggagttggtgacttagtgtagtctgtggctgacctagaaagacacagagttatcaagagtttcccttcctagaagatgaatgttaccttttgtgttaggaggtagagaaaataaaaatagcttttttttccctagaattgctaattactcttaacaacaaattaaattcaaagcctgtccttgagaactggaaatgtaaaatcatggttcaagttttataccttagtgattcctcagtaggtgttactaggagttcactgaatgaacttaggagtgaaccttcgatgtgcttgattttcttttgtgccttagtttctctgaatagcagaggcatcaaattttggtggggaatgagaggagtattaggggaaagtttgaaaatagctctcctggagatggagggcacacagagtggtcctcaggctcaccttgactgagttgattcacagttatcctgcatcagaccattagatttctttagtgctatgattataatagggatttttgaatcaccaaaaacagtttttagatgtttatgttctttgttttactatcaatgttgtgctggttaagggagagaaaagttcaagaagatcttacatatttgaaaggaaattggtactcttgaaggctatgcaacatgagtctttgaacaagaattccttgctactttgattcattcatcaaatactgagtgcctgtgtgccaggcacaggtgaactctggggattcaggggtaactaaaacagattggaaccctgcccttgtgaagctttcagtctagaagggagacgtgaaacaaattttagcttcaaaagcaacatctatttttgcctgttagcatgcatttattttaaaagtcatattagagttacctggttccacttcagagcagactgggaaaatcaggcttacaatggaatcagatgctgtgggcctaaaacagctctttaaaaatctatttttttaggccaggtgcgttggctcacacctgtaatcccagcactttgggaggccaaggtgggtggatatgaggtcaggaggtcgagaccagcctggccaatatgatgaaaccttacctctactaaaaataaaaaattagccgggcatggtggcacatgcctgtagtcccagctactcgggaaactgaggcagaagaatcgcttgaacccgggaggcggaggttgcagtgagccgggatcacgtcactgtactccagcctgggcaagagtgagacaccgtctcaaaaaaaaaaaaaatttttttttaaatggaatcagagaaaccaacaaaatatgtaacatgtataaatgcctgaggagatcagttattgagaaatccatttacaatgctggaggagaggggatggccaggaaagaagtgcaacaaataaatggaagatgaccctaaaaatgcaccagtgacagtcagtcaatccatcagaccacctcacatgcagggtagaaacatggagtgtgcggcagcatcctcctcacatccctttgtgagcacggctgctccggaatactgaccatctgggctagcacgacttagcagagggttctgcaggatgtgctattttaaagcagctgggtgcaacttgtgaaaacgggaatctagagcagaacatgtaatcagcgatggctgggattggtggacaggattgacaggagtatttgaggctctaccaggcctgtctacaggacagcttcatcaaagggacattttttaacctgttattttaaatgccacatatatgttgtaatgctgaagcatacaggtagaatttctggatcgtaactactagtgacttctgaggtttacagttagaaaatgttctcaaaggtttatcagttatgtattgatgattggtaatctagaccctctggaggctgtagaatgtgaaaagatacagctgagctgacaagttttagggcactatcttctggaatgaaatcggccaagaaaatggttcaagggcatgggggttagagaatgtttcttttacctaaaaatgttaagccaactatggaagattggggtcgtgggggcatgaaatacaaaattatgataatttatacagaactaggtttctttatgttctgcaagaaggtttttattagctaatttggggaggggggcatgctgcagtattttttttcctgggaacatgcatttctgatgggaagttattttgtttacaagagttggttttacacacaaccctgaatgaatgtgtctatggcctaaaaatggtagacctgtatttcctcaattttccgaggcatggcgacgaggcgcgctgggctctgaaacggaccaggacctttctcacccacgta

SEQ ID NO: 297137 - DNA, 903 bp, Homo sapiens
tgcatgctctgttgtggtccagtggccttcccagccctgtgccccaaagcacctggagcatatagccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaacaaaacagaccaacagcgtacgcgagagacactattgctggcgcgcctcgggcccggaaaaagcgtttttagagacaccttgtgtgtggcgcgcgggcccccagaaggtataggacaacaagggccaaaagcggcgacccagagacaaacccgcgtccacgaaaaacaggccggagaatccccacacaatcaaaaaaccccgcgggagaaaccgcggctcgaacaacacccgaagggggccagaggacaccaggggctacccaagagggccacaggagccgcatacaagtcccg

SEQ ID NO: 297138 - DNA, 855 bp, Homo sapiens
tgcatgctctgttgtggtccagtggccttcccagccctgtgccccaaagcacctggagcatatagccttgcagaacttctacttgcctgcctccctgcctctggccatggcctgccggtgcctcagcttccttctgatggggaccttcctgtcaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaacaaaacagaccaacagcgtacgcgagagacactattgctggcgcgcctcgggcccggaaaaagcgtttttagagacaccttgtgtgtggcgcgcgggcccccagaaggtataggacaacaagggccaaaagcggcgacccagagacaaacccgcgtccacgaaaaacaggccggagaatccccacacaatcaaaaaaccccgcgggagaaaccgcggctcgaacaacacccgaagggggccagaggacaccaggggctacccaagagggccacaggagccgcatacaagtcccg

SEQ ID NO: 297139 - DNA, 874 bp, Homo sapiens
acgtgctcaaaagtagtttttaaaaagagacaaaagaggccaggcgcagtggctcacgcctgtaatcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagttatgtcctcgttctttggatttgaaaaaagttgatataactacacaatagataacgtttatgaaaggtatgtataaaaaaacataattcctggtggctgctgaaatgaaactttgaatttctatattttgctttgtctttcataaaatttaaagaaa

SEQ ID NO: 297140 - DNA, 2626 bp, Homo sapiens
atcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcacccccctcggcctcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagttatgtcctcgttctttggatttgaaaaaagttgatataactacacaatagataacgtttatgaaaggtatgtataaaaaaacataattcctggtggctgctgaaatgaaactttgaatttctatattttgctttgtctttcataaaatttaaagaaa

SEQ ID NO: 297141 - DNA, 1237 bp, Homo sapiens
caggtcgactttaggggttccccaacgatggtcctcagctagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcacccccctcggcctcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagtta

SEQ ID NO: 297142 - DNA, 2417 bp, Homo sapiens
atcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcacccccctcggcctcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaagattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagtta

SEQ ID NO: 297143 - DNA, 719 bp, Homo sapiens
acgtgctcaaaagtagtttttaaaaagagacaaaagaggccaggcgcagtggctcacgcctgtaatcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagtta

SEQ ID NO: 297144 - DNA, 2471 bp, Homo sapiens
atcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcacccccctcggcctcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagtta

SEQ ID NO: 297145 - DNA, 4856 bp, Homo sapiens
gtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtatttcagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaagaaaaaaagagagaagaaaaaggagagatgaaaaaggaggatgaggagaagaattaccttttgacaatctgttaggaaggtatgcagtgtgagaactgaagtatttctgatcactctcagactgtcctccgtgatttatgctgacttaactgtttacctataaaccccatacaaagcagggtcataatttgtgatctgtggtggatttctagcagtcatcacaggcttctactgaaagtcctgaaaagaccttgcagtagtccaagctacaccaaacattaacacatatttgtggtaaacatttctgtataaagttacctgacacacatataaacacaaggaacattccatatcattagtcgaaaacaaaaacaaaaaaaaaac

SEQ ID NO: 297146 - DNA, 1001 bp, Homo sapiens
gacgaccctgtggctgtgagaaagcttatcaatttctctcacaacttcctctgcatccacagactctctgcccagatccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaagaaaaaaagagagaagaaaaaggagagatgaaaaaggaggatgaggagaagaattaccttttgacaatctgttaggaaggtatgcagtgtgagaactgaagtatttctgatcactctcagactgtcctccgtgatttatgctgacttaactgtttacctataaaccccatacaaagcagggtcataatttgtgatctgtggtggatttctagcagtcatcacaggcttctactgaaagtcctgaaaagaccttgcagtagtccaagctacaccaaacattaacacatatttgtggtaaacatttctgtataaagttacctgacacacatataaacacaaggaacattccatatcattagtcgaaaacaaaaacaaaaaaaaaac

SEQ ID NO: 297147 - DNA, 4324 bp, Homo sapiens
  misc_feature (4278)..(4278): n is a, c, g, or t
gtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtatttcagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaagcttatcaatttctctcacttcttccccccatcctcagacattaaagangcctgaatgcaaaaagaaataaagttagggaccgagctgatgtata

SEQ ID NO: 297148 - DNA, 4468 bp, Homo sapiens
gtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtatttcagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagag

SEQ ID NO: 297149 - DNA, 2942 bp, Homo sapiens
gcggccgcgtcgactgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagtttgtggggttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagttta

SEQ ID NO: 297150 - DNA, 2237 bp, Homo sapiens
atggcctgccactacgctcctcatcttcaaggctctcatctcctttgcaaacttcttgaaccaccactgcgctgatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagtttgtggggttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaa

SEQ ID NO: 297151 - DNA, 1899 bp, Homo sapiens
ggctaattttttctgcatttttagtagagacggggtttcaccatgttagccaggatggtctcaatctcctgacctcgtgatccacccgccttggcctcccaaagtgctgggattacaggcgtgagccaccgcgcccggccacactgtgatttcttatactttatggatggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagtttgtggggttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaa

SEQ ID NO: 297152 - DNA, 1289 bp, Homo sapiens
gcggccgcgtcgactgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagtttatgctgcataaactattcaatattattatgtccagaagtgtatatatgctgagtttcattctagctaagaatagaaagaagaataaaaggagactaggtttttatttgacctttgaacaaagacagtagatccctgatactgagtgactctttaagagtggccactcatcaacacctatgggctgattcagagaaacaggaaggtagaaattaagaagagattctttacctgaatcttgccagatgcagtcccgctactgttctgtccttctgctg

SEQ ID NO: 297153 - DNA, 385 bp, Homo sapiens
tgtttgacactctactagaagagtactctgtactaaacaaagacatccaggaggattctggcatggaaccccgcaatgaggaagaagggaacagtgaagaaataaaagctaaagttaaagtgagttattttttcctaagagattctaccttagtttttatacacagttcctgtgacaactcaaaataacatcaatttctaggcagtgagtgttgaattcagggagactatcagatgaaaaccatggctcctttatagttctggtatttaggagagatcaccactattattacatgctaactaccttgcaagcttttatagaatgtggatattaaaattggaagctcttataagaaaattcatatgattataagctatctttaaaa

SEQ ID NO: 297154 - DNA, 3111 bp, Homo sapiens
gcggccgcgtcgactgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagtttgtggggttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaa

SEQ ID NO: 297155 - DNA, 1896 bp, Homo sapiens
gcggccgcgtcgactgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgt

SEQ ID NO: 297156 - DNA, 3292 bp, Homo sapiens
gcggccgcgtcgactgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagtttgtggggttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaaaaaaaaaaaaacaaaaaaaaatttggggcgccgaggcagaaaatctcaaaccatcgtggggggcggcgccaaaggtagataacgggcaaggtcaagaacggccagacaggtggtgtcccaaaaaacccgggaccagtttgaaacccagggcggggcagggacacaagcagcaaacagcagg

SEQ ID NO: 297157 - DNA, 532 bp, Homo sapiens
atgaaggaagacattggaaaagcatcaaaaacccaaaagggaaaaagaaatgacccgtattctccacagttgtgtgtgtgtgtgtgtgtggtgcatgggtactcgtatatatatatactcacagccttttctcttcctccactcaaggatgatactggacacattcctttgtcatgggctttgtccgcttagccatctagtgaggacgctcctcactcactgagtactctgctatgacactgctttgtaacagctgtacaggtttttgtagtcagggcactcctgggtcataactgattctaaactagaatcagacacgggaagttttcatgacagttgtcattgttatttctctgggctcaggtcaagagccactgttcctttgtatcctcaccgagcaattgtgtaagaatgcaacaatactcattttgtacatccattggtattttgactacctattatttgctgggctttgctggaggttgggaatactgacatgattctacaacatccatcttacaaaaaaaagaaa

SEQ ID NO: 297158 - DNA, 1705 bp, Homo sapiens
atgggaagacgactcagaggtcagagatacttggggaggggaggctgagtttgaaatcatgcttaagatgccagtggctcgacctgtggttggtttaagttctaatttttaaaaagctagttagagaacagaaaatcattgggccaagtcacacctgtactttttttttccccctcctctgtctccaacctctttctaggttcttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaaaaggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 297159 - DNA, 3103 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaa

SEQ ID NO: 297160 - DNA, 2493 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaaaaggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 297161 - DNA, 583 bp, Homo sapiens
tgtatttatcttttattgattctctcccgtgttgtttgatttttggtgttccacgggactcgtggtcaccaccgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaa

SEQ ID NO: 297162 - DNA, 204 bp, Homo sapiens
cgctcctggtggggtcagcgccttctgcagtgacaccattccctacctgcacatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaa

SEQ ID NO: 297163 - DNA, 5978 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaagtac

SEQ ID NO: 297164 - DNA, 5795 bp, Homo sapiens
ctgtttttgacagcagaggaccccagttgttgaggactaaagagagagaagatgagaaagaagatgctggaaacagaggttggagaaagagaggcaaggaagtagaaaggaggaaaaggggaagagaggaggcagggggagagagggttggaattcgagctattttcagctgaatgtgagtgcagatttcatcaggcttctgggctacagggaaactgactgtgtgcggaccttgcgtgtaacttcctgtgaagcagccgtggtgactgcattttctgacactgtcagagtctggacaaccctgccagctcctagaagggcaacccaacaactgtcacagacgaagcatcaaaagcatgagctgtcgatagtgacctgcatttgcagaaaatctgagggctttctaattaacagaggagctctaaattagagtaaagctgttcgacaagacccctcatacgcgataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaagtac

SEQ ID NO: 297165 - DNA, 5402 bp, Homo sapiens
gcggccgccgccgcagcctccgcaggcgcaagccccgcagccgcccccgccgccgcagctcgggggcgcggggggcggcagcagcaggcacgagaagagcctggggctgctcactaccaagttcgtgtcgctgctgcaggaggccaaggacggcgttctggatctcaaagcggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaagtac

SEQ ID NO: 297166 - DNA, 1503 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaa

SEQ ID NO: 297167 - DNA, 715 bp, Homo sapiens
atgggaagacgactcagaggtcagagatacttggggaggggaggctgagtttgaaatcatgcttaagatgccagtggctcgacctgtggttggtttaagttctaatttttaaaaagctagttagagaacagaaaatcattgggccaagtcacacctgtactttttttttccccctcctctgtctccaacctctttctaggttcttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaa

SEQ ID NO: 297168 - DNA, 890 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagctcagactgaactggaggatgtatttgtgtaccttatggtgtaattgtaaatgagactataaattatagtatgctattatgattacttatttttcttttctctttatttatgtgattctgaataaaaacgactgacttctga

SEQ ID NO: 297169 - DNA, 1416 bp, Homo sapiens
tttttttttagtctcatattttatgatggggggaaatattcatggaagattactgaatgtgaaactgctgttcccttatagaaaagacccaaacattatcccatcatgtcagatttgaggttttggcttattgcacataggaatctttaaattaggtttgggctgtcataaagttagctttttgagagactagagaaaaaatatgacaagtcctataaaatagtaaagtctgctcctgttgatatataacattttttctctttaaaatcatgaacatagacatttatatcagggtatttaaaattatttgcctagacagtatagctggtatttagataatgatatatcagacagatactctaaagaagggagatatagtaattcaaaatggaaatacattagcatgctcttaaaagtaaatcaaatacaatatgcttttcagaatttagaaaatgaacttaccttttctttttgtatccattctgattctctcctagctcagactgaactggaggatgtatttgtgtaccttatggtgtaattgtaaatgagactataaattatagtatgctattatgattacttatttttcttttctctttatttatgtgattctgaataaaaacgactgacttctgaagtgaattttcagcatggcagttaaaacaaaaaaacaccactaccacaaaaaacaatatactggtgaacattttacttaccttcaaaatccagagagtagagaatattgttttctaataagtacctaggattttcatagggagcctatgtttgtgaggccactatccaaagactaatgttcatgaaactgggagtcctatatacaagctgtatttgtaaataagacagagaaaggttgtgaactggcagcttggatgttttgtcaaagtacaatgtcagagaaactctttctaagacaaattgtaaatagaactgtcacagtgattgcatgattgagccgcagaagtgtcctacaattgttggcattgtcaggacttttgaaagcttaattaaacacagtggcccgcatggctgctaaacttactaaggaaagccaaaaggaaaaaaaaaatatatctaaaatgtagaagatcctaaagatcccaaacttcttcagacattacccttgtggtgacacagaaaagatgcattgtgcattttcctagtcatcttttataaataatgttttgagaataggtccacgtgatatgaagatcatcctgtgtgtgatgtggagattgtgttagtttttctgtctcctgctgttacagacagttaatgtaaaaatggccttttattggaaacacaaatatgtattcacttcaagaacaggagcagagggggacaaagtttccctcccgttctctgtgtttattctgtgaaagcttaaaaaaacaa

SEQ ID NO: 297170 - DNA, 6080 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaagtac

SEQ ID NO: 297171 - DNA, 4093 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaaaaggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 297172 - DNA, 3042 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaa

SEQ ID NO: 297173 - DNA, 5309 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttca

SEQ ID NO: 297174 - DNA, 5704 bp, Homo sapiens
atcagacgcggcggcggcggtgtgaagttacagcccggccagccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaagtac

SEQ ID NO: 297175 - DNA, 1667 bp, Homo sapiens
tgacgttcaagttcgcagggacgtcacgtccgcacttgaacttgcagctcaggggggcttttgccatttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagctcagactgaactggaggatgtatttgtgtaccttatggtgtaattgtaaatgagactataaattatagtatgctattatgattacttatttttcttttctctttatttatgtgattctgaataaaaacgactgacttctgaagtgaattttcagcatggcagttaaaacaaaaaaacaccactaccacaaaaaacaatatactggtgaacattttacttaccttcaaaatccagagagtagagaatattgttttctaataagtacctaggattttcatagggagcctatgtttgtgaggccactatccaaagactaatgttcatgaaactgggagtcctatatacaagctgtatttgtaaataagacagagaaaggttgtgaactggcagcttggatgttttgtcaaagtacaatgtcagagaaactctttctaagacaaattgtaaatagaactgtcacagtgattgcatgattgagccgcagaagtgtcctacaattgttggcattgtcaggacttttgaaagcttaattaaacacagtggcccgcatggctgctaaacttactaaggaaagccaaaaggaaaaaaaaaatatatctaaaatgtagaagatcctaaagatcccaaacttcttcagacattacccttgtggtgacacagaaaagatgcattgtgcattttcctagtcatcttttataaataatgttttgagaataggtccacgtgatatgaagatcatcctgtgtgtgatgtggagattgtgttagtttttctgtctcctgctgttacagacagttaatgtaaaaatggccttttattggaaacacaaatatgtattcacttcaagaacaggagcagagggggacaaagtttccctcccgttctctgtgtttattctgtgaaagcttaaaaaaacaa

SEQ ID NO: 297176 - DNA, 636 bp, Homo sapiens
gttattacttgtttcgaatttaaaacgcctccctaaagggatattggcccccaaggcccaaaatttcggcacaaggaggggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaa

SEQ ID NO: 297177 - DNA, 749 bp, Homo sapiens
gtaaagagcgaacaaacagatcaagcactttggcatgcttcgccgctgtggatgactgccataaatttacctgtcagcacaacgtccaccatggtgtgcgacggagacagccaattaccatggtcatttggtgcattgacctagaggtggaggagaaatgtgcactcattgagcaggtggcccaccagacaatcgtcctaacctatattggttggactgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaa

SEQ ID NO: 297178 - DNA, 814 bp, Homo sapiens
  misc_feature (662)..(663): n is a, c, g, or t
  misc_feature (667)..(667): n is a, c, g, or t
gagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaaaaacaaaaccaaacaaaaaaatttgggggggccgccggggcccgaaaaagttttctaaacccnntcgnttgggggcgggccccgagggtagggacctggcaaagcgggccccgggaaacccggcctgaacagggcgggtctccaccaataaaaagcccggggcaccgggtctgaacccaggggtcggggctacgggctccagggccaggcgatac

SEQ ID NO: 297179 - DNA, 651 bp, Homo sapiens
  misc_feature (26)..(26): n is a, c, g, or t
  misc_feature (34)..(34): n is a, c, g, or t
  misc_feature (41)..(41): n is a, c, g, or t
cacagaggatgaaacacggcgatctnaggacacnagcttcnttttaccacccttgactaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaaaattttaaaacccaataccctcaatcgctgaacacccttttaaaaaaaaaaacatgtcggccgcttgggcccagcggactttgccctattgggggc

SEQ ID NO: 297180 - DNA, 635 bp, Homo sapiens
  misc_feature (26)..(26): n is a, c, g, or t
  misc_feature (34)..(34): n is a, c, g, or t
  misc_feature (41)..(41): n is a, c, g, or t
cacagaggatgaaacacggcgatctnaggacacnagcttcnttttaccacccttgactaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaaaaatttaaacacaataggcccaaatcgggaaaacccctttaaaaaaatggacgaattggggcccattggcaattggcata

SEQ ID NO: 297181 - DNA, 556 bp, Homo sapiens
tcataggttcgcaggcatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaa

SEQ ID NO: 297182 - DNA, 673 bp, Homo sapiens
gagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaaaaaaagaagaaaaaaaaaaaaattttggggggcgggttggggccttggagaaggtttttaggacacttggtggg

SEQ ID NO: 297183 - DNA, 618 bp, Homo sapiens
gagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaaactctttcaggacttcttt

SEQ ID NO: 297184 - DNA, 599 bp, Homo sapiens
gagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaa

SEQ ID NO: 297185 - DNA, 774 bp, Homo sapiens
gagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaaaaaaaaaaaaacaaaagagacaacaactctttttgtggccgcccttggcccccgaaaaagtttttaaaaccatccttttggggggggggcccctgtgggttctggagcccggggccaagagtgttcccaagagacccgggcggaactaggggtggggttccccccataaaaggcc

SEQ ID NO: 297186 - DNA, 478 bp, Homo sapiens
gagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcgaacctatgagggtaccgagctcg

SEQ ID NO: 297187 - DNA, 1556 bp, Homo sapiens
  misc_feature (1279)..(1279): n is a, c, g, or t
  misc_feature (1300)..(1300): n is a, c, g, or t
  misc_feature (1337)..(1337): n is a, c, g, or t
  misc_feature (1355)..(1355): n is a, c, g, or t
caggcgtggtcgggtgcgtggtgcgtgggtccggctttcggtgactagacggtccgcagggacatcccgtccctggggcctccccagtctccctccccctcgcgcctgggcagctctctcccagggcttcggctcgagcctgcgacctgcacggacacccccccctcaggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttggtttttttggtggtgttatttgattttgatttttttttctttatgggatctttgggaaacacattcaaaatatatctcgtttctacttaaatgtagtgcttagggttaatttttgtactgaagtctttattgggggtgcntgctacgggaaccagttttgnccaaaacttaatcaaaatactgggcttactgaaactntgttatactagcctctgnccctcccgagaagactgttggattgaacaaataatatgtattttgatttacttaaaagggcttggaaatgtcttaagggccctgccacttttgactgtggatcagttgatgtacactagtattattaaagcactcattaatcccgatgcggccgcttcctttagggagggtaattatgatcctggttacttgactcttggc

SEQ ID NO: 297188 - DNA, 1173 bp, Homo sapiens
  misc_feature (896)..(896): n is a, c, g, or t
  misc_feature (917)..(917): n is a, c, g, or t
  misc_feature (954)..(954): n is a, c, g, or t
  misc_feature (972)..(972): n is a, c, g, or t
catttgtatgtcttatttcagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttggtttttttggtggtgttatttgattttgatttttttttctttatgggatctttgggaaacacattcaaaatatatctcgtttctacttaaatgtagtgcttagggttaatttttgtactgaagtctttattgggggtgcntgctacgggaaccagttttgnccaaaacttaatcaaaatactgggcttactgaaactntgttatactagcctctgnccctcccgagaagactgttggattgaacaaataatatgtattttgatttacttaaaagggcttggaaatgtcttaagggccctgccacttttgactgtggatcagttgatgtacactagtattattaaagcactcattaatcccgatgcggccgcttcctttagggagggtaattatgatcctggttacttgactcttggc

SEQ ID NO: 297189 - DNA, 1617 bp, Homo sapiens
  misc_feature (1340)..(1340): n is a, c, g, or t
  misc_feature (1361)..(1361): n is a, c, g, or t
  misc_feature (1398)..(1398): n is a, c, g, or t
  misc_feature (1416)..(1416): n is a, c, g, or t
cgcggcgccgcatggccgacgtggggctcgcgctctcgcggtctctcccgggcgggcgcgcaggcacgcgcactcgcgggtgcgcgcgcggacggccgggcggcggcggctcccggaggtggtggcttcactttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttggtttttttggtggtgttatttgattttgatttttttttctttatgggatctttgggaaacacattcaaaatatatctcgtttctacttaaatgtagtgcttagggttaatttttgtactgaagtctttattgggggtgcntgctacgggaaccagttttgnccaaaacttaatcaaaatactgggcttactgaaactntgttatactagcctctgnccctcccgagaagactgttggattgaacaaataatatgtattttgatttacttaaaagggcttggaaatgtcttaagggccctgccacttttgactgtggatcagttgatgtacactagtattattaaagcactcattaatcccgatgcggccgcttcctttagggagggtaattatgatcctggttacttgactcttggc

SEQ ID NO: 297190 - DNA, 840 bp, Homo sapiens
  misc_feature (563)..(563): n is a, c, g, or t
  misc_feature (584)..(584): n is a, c, g, or t
  misc_feature (621)..(621): n is a, c, g, or t
  misc_feature (639)..(639): n is a, c, g, or t
gctttgctggactgactctcttaactaccatcgctacacgatctaaaatgtccactgaggcacaaagagttgatgacagtccaagcactagtggaggaagttccgatggagatcaacgtgaaagtgttcagcaagaaccagaaagagaacaagttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttggtttttttggtggtgttatttgattttgatttttttttctttatgggatctttgggaaacacattcaaaatatatctcgtttctacttaaatgtagtgcttagggttaatttttgtactgaagtctttattgggggtgcntgctacgggaaccagttttgnccaaaacttaatcaaaatactgggcttactgaaactntgttatactagcctctgnccctcccgagaagactgttggattgaacaaataatatgtattttgatttacttaaaagggcttggaaatgtcttaagggccctgccacttttgactgtggatcagttgatgtacactagtattattaaagcactcattaatcccgatgcggccgcttcctttagggagggtaattatgatcctggttacttgactcttggc

SEQ ID NO: 297191 - DNA, 1628 bp, Homo sapiens
  misc_feature (1351)..(1351): n is a, c, g, or t
  misc_feature (1372)..(1372): n is a, c, g, or t
  misc_feature (1409)..(1409): n is a, c, g, or t
  misc_feature (1427)..(1427): n is a, c, g, or t
caggcgtggtcgggtgcgtggtgcgtgggtccggctttcggtgactagacggtccgcagggacatcccgtccctggggcctccccagtctccctccccctcgcgcctgggcagctctctcccagggcttcggctcgagcctgcgacctgcacggacacccccccctcaggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagcaccaacataacactgaaaggaaatgctcattcaattctcaattggatttttggattttggatgcccactagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttggtttttttggtggtgttatttgattttgatttttttttctttatgggatctttgggaaacacattcaaaatatatctcgtttctacttaaatgtagtgcttagggttaatttttgtactgaagtctttattgggggtgcntgctacgggaaccagttttgnccaaaacttaatcaaaatactgggcttactgaaactntgttatactagcctctgnccctcccgagaagactgttggattgaacaaataatatgtattttgatttacttaaaagggcttggaaatgtcttaagggccctgccacttttgactgtggatcagttgatgtacactagtattattaaagcactcattaatcccgatgcggccgcttcctttagggagggtaattatgatcctggttacttgactcttggc

SEQ ID NO: 297192 - DNA, 1689 bp, Homo sapiens
  misc_feature (1412)..(1412): n is a, c, g, or t
  misc_feature (1433)..(1433): n is a, c, g, or t
  misc_feature (1470)..(1470): n is a, c, g, or t
  misc_feature (1488)..(1488): n is a, c, g, or t
cgcggcgccgcatggccgacgtggggctcgcgctctcgcggtctctcccgggcgggcgcgcaggcacgcgcactcgcgggtgcgcgcgcggacggccgggcggcggcggctcccggaggtggtggcttcactttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagcaccaacataacactgaaaggaaatgctcattcaattctcaattggatttttggattttggatgcccactagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttggtttttttggtggtgttatttgattttgatttttttttctttatgggatctttgggaaacacattcaaaatatatctcgtttctacttaaatgtagtgcttagggttaatttttgtactgaagtctttattgggggtgcntgctacgggaaccagttttgnccaaaacttaatcaaaatactgggcttactgaaactntgttatactagcctctgnccctcccgagaagactgttggattgaacaaataatatgtattttgatttacttaaaagggcttggaaatgtcttaagggccctgccacttttgactgtggatcagttgatgtacactagtattattaaagcactcattaatcccgatgcggccgcttcctttagggagggtaattatgatcctggttacttgactcttggc

SEQ ID NO: 297193 - DNA, 924 bp, Homo sapiens
tcaggatggcttgcactgaagctaacctgacatgtgtttcagaactccctgtgggctggacccaggaatatatactctggtcaatggagcggagccttcaacagatcttccgatacctagaaagcgcaagatcaaggcttgtggaacaggatttgcctgaatcacaggatatgatttcttcctctaccacctctgttcttgtggctcagaagactgttctatgctgttgtgactataagaaagcaaaacattctactgaccacagcatctcctttagttcatcatgcaatgactccagtctgtctcatcttcctgtcttttctgaaggaacaacttgggaattccggagccatagtttacctatttcccacaaaaagcaatcctctgtgttcaggaaccaaggcagaaccctgcctctttttcagctctcagagccccagaaatcaaaaatttttcagaatttggcagatctttcacccttacaacctcagagctcttttatcaactctatttctgaacccctaaatatctgcaaacaaaaaaggaaaaaaaatgatgagagaatgagcaagagtcatttgacatcagatcatgagccaaattctgtttccaaggagagaccacgacttccaaggtgggctacattcaagctctctccttcagttagaagggagctagaaggacatatgtctcagaaggtttttgctttgcggcaacaaacagcacctttacctttgaggaaatcatgggcaatgctgaattatataactgaagtacaaggaggagttgctgaatcagagaaaccccaaactcagttatctatgcccattcatcaaaacactgagcaaaatatcaacaacaaatcctcagaccttccatcatttcagctccatgtgaatgctggagtgggatctggatcaaata

SEQ ID NO: 297194 - DNA, 913 bp, Homo sapiens
agaaactttttttttttttcaaattctccttcaggccaaaaatattttgcatttgaaatggccacttttttcgttttcctatttcaatgcaaactgaaacatttctctttatttcttagatcaaggcttgtggaacaggatttgcctgaatcacaggatatgatttcttcctctaccacctctgttcttgtggctcagaagactgttctatgctgttgtgactataagaaagcaaaacattctactgaccacagcatctcctttagttcatcatgcaatgactccagtctgtctcatcttcctgtcttttctgaaggaacaacttgggaattccggagccatagtttacctatttcccacaaaaagcaatcctctgtgttcaggaaccaaggcagaaccctgcctctttttcagctctcagagccccagaaatcaaaaatttttcagaatttggcagatctttcacccttacaacctcagagctcttttatcaactctatttctgaacccctaaatatctgcaaacaaaaaaggaaaaaaaatgatgagagaatgagcaagagtcatttgacatcagatcatgagccaaattctgtttccaaggagagaccacgacttccaaggtgggctacattcaagctctctccttcagttagaagggagctagaaggacatatgtctcagaaggtttttgctttgcggcaacaaacagcacctttacctttgaggaaatcatgggcaatgctgaattatataactgaagtacaaggaggagttgctgaatcagagaaaccccaaactcagttatctatgcccattcatcaaaacactgagcaaaatatcaacaacaaatcctcagaccttccatcatttcagctccatgtgaatgctggagtgggatctggatcaaata

SEQ ID NO: 297195 - DNA, 402 bp, Homo sapiens
aacatttttgtatagaaatgggtttttgccagattacccagtctggtcttgaactcctggcctcaggcgatctgtccgcctcagcctcccagagtgctgcaattacaggcatgagccatcgcgacggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatggaaaaaaaaaaa

SEQ ID NO: 297196 - DNA, 986 bp, Homo sapiens
actcattccattcacagactcttgttgggcagcagccacccgctcacctccatccccaggacttagagggacgcagggcgttgggaacagaggacactccaggcgctgaccctgggaggccaggaccaggccaaagtcccgtgggcaagaggagtcctcagaggtccttcattcagcggttccgggaggtctgggaagcccacggcctggctggggcagggtcaacgccgccaggccgccatggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtgaccaacagggaggacagggcctgggactgttctcccagatccgccactccccatgtccccatgtccttcccccactaaatggccagagaggccctggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatggaaaaaaaaaaa

SEQ ID NO: 297197 - DNA, 2424 bp, Homo sapiens
gcaggactgccaccccaggccccgtgggaggcctgctgagggcacagagctgctcggtgcagccttcatgctttgatctggaaagagcagctgtccgcaggcctctgtctccaagaggcctgtcacacaggaggaccgctggaaacataccaacacgtgcagtctcccctccaagctattcatgctgtttgtggaatctctctcaaacataagtgtcaggtgtgtgtcgtcccaacgggtcctgtgctgtgaatagatccatgtgcagcacaaagggaatgtggcacgtggccccaggaagagttcacccggccagggggcagttgttcagttgcctggggctgacactgaccactggcctctggggtgtcctgcagcccaaatgcccaccttgccctcctcacatctcagtcaggggaggccatgcccaagccaatgtgctgtcacagcctgcagcgggggcagcacttcctcggagggcctgggaggtgctggggatgccccagcgcttctcttcctgcctcgccctggcatggcccagcgcctctaggatcaacttacgatccgtggagcagccccgggaaacccaaatctggctcaggacagcgtacgggcaggagggctgtaaatcatcccaggctaagcctccgtgggcactggctcctgccgcagcctggctatggactcagttagaaccaggtagaaagtcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggaggagccctcaccagccgatcttgtcactctccgtggtgacagtgtcttggccagctgtggcccctagtttctagcagcgtttctcagtgtccttggcccttctgagaaggcaggcgggaggcacacggtgccctggttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaaagagaaaaaatgttatttttactttctggaaaaaataaatattctcattgttgtagaaagaaaaaaag

SEQ ID NO: 297198 - DNA, 1066 bp, Homo sapiens
aataaataaataaaagtttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297199 - DNA, 1686 bp, Homo sapiens
agcgggtgcgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297200 - DNA, 1633 bp, Homo sapiens
agcgggtgcgtgtgcgagtgtgacagcggctgtggctgtggccgtggccgtgggaggcgggcccggcggagcccagccgcggggggaccggcccgggctcccgctccccgagcgcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297201 - DNA, 2912 bp, Homo sapiens
agcgggtgcgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacggcaccttcagaaaaatcaaaagggaaactaagattaaaatgtgcagaaagaaaattgtcaatatttacaaattaaaagatcagcaacattgattttctgtgtcgttgttatgaaagccttactagtggatgcaaagtggcatctcatttgggttttgccttgcattttattaatgaataatggtgtttagcatcttttcttttccttcttagacatttgtgtaacttctttgggagaaatgtctgttcaagtcctttgcctatttttttaattgggatcttagaaattctgttgttgagttgtgggatattaagcttttatcagatacacattttgattttatcagatacatattttctcacatattatgggttgccttttcactcccttgatagtatcctttgatttttattttgattaaatctaattttcgtgtattttcttttgttatctgtgcttttctgtcatatttcaaaatacacttaaaactcaaaggtcataaaggtttaccgtgtgttttcttctaagagttacatatttttagtccttacatttaagtcttttattaatttagaattaatttttgtatatactgcaaggtaggggtctaacttctctcttgtacactgacatccagctgttgaagagactgttctttcctcccttgactagacttggccaccttgttgaacagtcattgaccatatatgtgaggactaacttgtaggatctcaaatctgtcctattgtatttgtctgaaagtctattggtcttattccagtaccacactctcttgattactgtagatttgtagtagtctgtgaaactgaaaaatgtgagttttccaatgttctttttcaagactgttttgtctgtcagatcctttgaatttttgtatgattttagaatgagtttctttgtttctgcaaaaatgcctttgggattttgatggtattgcattgaatctgtagattactttagatggtattgtcatcttaacaatattgtcttacaacccgtgaacacagaatgtctttccacttatttccactctctttagttttttgcagcaatgttttgtgtataccaccatggttagatttatgcctgaataacgtattctttgatgtcattataaatggaatttttaaaatgttttcatagttctttacaactatatagaaatatagctcatttgcctatgtttgtttgcatcctgcctcctttattagttataatcggttttgtgttttgtttggagctttatacctataagatcatgtgtagatataattttacacctattttttatttctaatttagatgccttttatttctttgtcttgcctaattgctctggctagaactgccagtgctacgttgaatacaagtggcaaatgcaccatccttttcttctagatgttaggaaaacagctttcagtgtttcatcattgatcatgatattaactgttgggtttttgtacatcccattgtcatgttgcagaagatcccttctatgcctagtttatagagtatttttattatagaagggtgttgtatttcatcaatgttttctctgcagcaattgaaataatcacgtgcttattcattttactgttacagcatattacactgattgattttttatatgttgaaccacccatgcattttggggataaatctcaaagggtgatagtttacaatcctttgattatacagtattgctgctagtattttgctagtattgctagtattttgctgagatttttgcttatatattcataggggatatagtgctgtattt

SEQ ID NO: 297202 - DNA, 2199 bp, Homo sapiens
agcgggtgcgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggttatgaggctggttcttgggtttgactctgggaatcatgctcattgatctgcttttcctaatcatgtcagtgaatacctacacgtgaagaaaactcaagctgcaccataaagctaaaggaagaaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297203 - DNA, 1347 bp, Homo sapiens
agcgggtgcgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaa

SEQ ID NO: 297204 - DNA, 1254 bp, Homo sapiens
cttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297205 - DNA, 873 bp, Homo sapiens
cccagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297206 - DNA, 772 bp, Homo sapiens
tggacagcccagggtcaggggtttcagccgcctgttcaaggacaccgagatccacagcagccacctgggagctcctacacaactatgcccagcgattccaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattgttttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggcctt

SEQ ID NO: 297207 - DNA, 1558 bp, Homo sapiens
gggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297208 - DNA, 1704 bp, Homo sapiens
gggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctaaaaaaaaaaaaaagggggcgcggctaaaataaccccgaggggcaagttaacggttccacgttttgtacaagggcccaagagcgaattagaagggggcgcgtaaaaagttgcggccacagcacgggcctggggaccacctgggggaa

SEQ ID NO: 297209 - DNA, 1535 bp, Homo sapiens
gggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctcgcagcctttatccgaccgggttgggagtctgcactgttgataac

SEQ ID NO: 297210 - DNA, 1557 bp, Homo sapiens
  misc_feature (1162)..(1163): n is a, c, g, or t
  misc_feature (1181)..(1181): n is a, c, g, or t
  misc_feature (1248)..(1249): n is a, c, g, or t
gggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctcccccccccctcactccctccccccccacggccccccaccccaccccccccgcccacnnccccccactcccacactnccccacccaaccacctccccccacaatcccccccccccagaccccccccccccccaccccctgcccnnagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297211 - DNA, 1656 bp, Homo sapiens
gggcttccgtccattcttccggtggagatggctgcggccgtggcggggatgctgcgagggggtctcctgccccaggcgggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297212 - DNA, 1707 bp, Homo sapiens
gggcttccgtccattcttccggtggagatggctgcggccgtggcggggatgctgcgagggggtctcctgccccaggcgggtaaggagtggcccaggtcctcacggcgtgtcttgcggccgctctctagtcctcatctgccctcctctactactgattcttcccataatctctgaccccagctagatcgctggcctccttaccccgtccagttccttgtgactcgactggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297213 - DNA, 1557 bp, Homo sapiens
tagcaccccaagacaccacgcaccacacttagctagtcacaggccgcgtgttatggccgtggcggggatgctgcgagggggtctcctgccccaggcggactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297214 - DNA, 944 bp, Homo sapiens
  misc_feature (553)..(553): n is a, c, g, or t
  misc_feature (567)..(567): n is a, c, g, or t
  misc_feature (578)..(578): n is a, c, g, or t
  misc_feature (603)..(603): n is a, c, g, or t
  misc_feature (681)..(681): n is a, c, g, or t
  misc_feature (717)..(717): n is a, c, g, or t
  misc_feature (751)..(751): n is a, c, g, or t
  misc_feature (754)..(754): n is a, c, g, or t
  misc_feature (761)..(761): n is a, c, g, or t
  misc_feature (802)..(802): n is a, c, g, or t
  misc_feature (814)..(814): n is a, c, g, or t
  misc_feature (818)..(818): n is a, c, g, or t
  misc_feature (827)..(827): n is a, c, g, or t
  misc_feature (841)..(841): n is a, c, g, or t
  misc_feature (846)..(846): n is a, c, g, or t
  misc_feature (848)..(848): n is a, c, g, or t
  misc_feature (869)..(869): n is a, c, g, or t
  misc_feature (938)..(938): n is a, c, g, or t
gggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatcctcctcctaactcaacaccccaacctcaaccacatcctacccatcttaaccactctcacattcctccccntcctacctccctcnattcatcacancatcctcaccacccacccctttatnaactactccaacctccccaccctccccctcctcaacccccaccttctaccacccctcacctccctcacaccccacacncactccctcctccaccaccaccccctccacctcacnaccctcttccaccactacatcacacaccaccccncantccattntctcatctccccaaatcccaacccacatcctcacactcttncccattcctacncacnctctatacncacccctccccatnaatanantctcccttattccctctcgtntcttaaatcccaaatctccaacaattcccctcccccactctctttctaattccttttaatactaatcanattcta

SEQ ID NO: 297215 - DNA, 611 bp, Homo sapiens
tagcaccccaagacaccacgcaccacacttagctagtcacaggccgcgtgttatggccgtggcggggatgctgcgagggggtctcctgccccaggcgggtaaggagtggcccaggtcctcacggcgtgtcttgcggccgctctctagtcctcatctgccctcctctactactgattcttcccataatctctgaccccagctagatcgctggcctccttaccccgtccagttccttgtgactcgactggtaatcacagcaacaacgtccagatgttgtctgtctccagcgtttcttttgcctggaccactcctcgcccagacctttgcattatgtctccatcttaatgtgtcagtctaaatgtcacctcaggtcttcccttgactccttagccccgtcgcaatctgtaattttgcatttgtttagttgcttgtttcctctattaaactccgcaagggcagaaccatgttcattcagcatagccagcaggtggcatggtgctggatgttagtaagcgtgcggtagatatttgtttagtgaatggatttgagcacttaatataggccaggcactgtgataactatttttatatgtgttagctcatttaaatctt

SEQ ID NO: 297216 - DNA, 1747 bp, Homo sapiens
gggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctactttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccactagctaa

SEQ ID NO: 297217 - DNA, 1658 bp, Homo sapiens
atgaaaggttctgccattacaggaccagtagcaaaggagtgtgcagacttgtggccccggagtgcatccaatgctggcagcattgcatgattctccagtatatttgtaaaaaataaaaaaaaaaacgtttaaaccggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297218 - DNA, 1675 bp, Homo sapiens
tagcaccccaagacaccacgcaccacacttagctagtcacaggccgcgtgttatggccgtggcggggatgctgcgagggggtctcctgccccaggcgggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297219 - DNA, 1800 bp, Homo sapiens
ttctgctgtctctttaaatattgtctgtggctgcttttggcagagttgagcattagagacagattacatgggccccaaacttaaaatatttactgtttgaccattttaagaaaaagtttatttaaccttatcccctttttctttctctctctctctctctctttccttccttccttccttccttctttttttttctgagacggagtctttactctgtgcccaggctagagtgcagtggcatgatctcggctcactgcaacctccacctcccgggttcaagcgattctcctgcctcagcctctcaagtagctgggattacaggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattcta

SEQ ID NO: 297220 - DNA, 1702 bp, Homo sapiens
tttctgttatgccttttcatttctattcagataagatgtggatattgtgagtttctggcttgaaagctagaactgaggggttttttttgtttgtttgtttgtttgtttgttttgagatggagtctcgctctgttgccattgcactccagtctgggcgacaagagtgaaactccgtctcaaaaaaaaaaaaaaaaaaaaaaaaaaaagagcaatgtccttggatgtggtggtgaagggatttcagaataacatactcactggagcatggtgggatgtaccgccctagttgaagaaatcgtgatgtaacattgacagtcgttgggtataatgtgataacaggagcaagaaatgagtaatcaataaataccaattttattgaaataacagtgtttatttctctaaagaaagtaggagaatgagtctttagacttaaggagcatatactttaatgaaagagacagtacagatatcgtagaacaagtgactgaaagcacatgtctatttgtaaatgtctagaaagaaacattcaccctgagactaatcagtctgtgtagctatttagtgaatatttttcagtcaagggaaggaattaagactttaaatttaaaaaacaaaattgatctgggagcagcggcttgtgcctctaagcccagctactcaggaggctgagtcaggaggattgcttgaggccaggagtttgagaccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297221 - DNA, 394 bp, Homo sapiens
tattactagtgattactagtgaattcactagtaatcatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaaaaaaaacagactgtatttgcacccaataccttctgtctcccagacagcctcttcagagcttttcttttctttttcttttccttttttttttttaagacagggcactc

SEQ ID NO: 297222 - DNA, 455 bp, Homo sapiens
gatcccctgatggctgatgagatgtcttcaggctgtgcatctcagatcccgaggatgtactccagagcagatgaatggcctggcaactcttcgtcaatgagggtaagaccctagagagggagggggagtaggtggggcagtctcgcaggtgagagccaagctcagctccctctgagtgtattcatcaatagtcatcaatcagccaacagcatccactcaatgaccagccccgaactggaggctgcgtgggctgctgcacaggacagcaagaaaaagcaacctctgcctgatggcagctcctaattactcttctgttatcaaagtcattttgatggctgtccctgcttaacaagcaagaggtgagtaaagctcttgattgaggcaggacttatagactgtgtttcagggctgtggcaggctctgcaggggtcctctgtcccctcccctggcccctg

SEQ ID NO: 297223 - DNA, 297 bp, Homo sapiens
ccttacaccaactcctcttcctcccggacagaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaagggtgaggaggaagaaggaagccccactacatgacaaagaaatgcagcatgaggggatgcagttagacttcagaaag

SEQ ID NO: 297224 - DNA, 4268 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297225 - DNA, 4376 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaaaaaaaacagactgtatttgcacccaataccttctgtctcccagacagcctcttcagagcttttcttttctttttcttttccttttttttttttaagacagggcactc

SEQ ID NO: 297226 - DNA, 4503 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaagagtttattgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggacaccactccccgcctgcccctcctcctcctatatca

SEQ ID NO: 297227 - DNA, 4355 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaaaaaaaacagactgtatttgcacccaataccttctgtctcccagacagcctcttcagagcttttcttttctttttcttttccttttttttttttaagacagggcactc

SEQ ID NO: 297228 - DNA, 3598 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacatagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaaaaaaaacagactgtatttgcacccaataccttctgtctcccagacagcctcttcagagcttttcttttctttttcttttccttttttttttttaagacagggcactc

SEQ ID NO: 297229 - DNA, 4004 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctctggcaccatcaaacacttctttgtttcccttctttagtaagaacccctatatatgaggggcagct

SEQ ID NO: 297230 - DNA, 3415 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggcatacatcagaatcaagcttatct

SEQ ID NO: 297231 - DNA, 4191 bp, Homo sapiens
tgtttggcctataggactctgtagggagagcctgggtcagccctgcacagcattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297232 - DNA, 3024 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctcatgtagggggatcctttaaagttggccttcccg

SEQ ID NO: 297233 - DNA, 3080 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctatgaccatgactttacccagtcagcgcctctcgactacacctgactggccgtatactctagccagctacagctctgcacgtatcgcatca

SEQ ID NO: 297234 - DNA, 3900 bp, Homo sapiens
tgtttggcctataggactctgtagggagagcctgggtcagccctgcacagcattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297235 - DNA, 3761 bp, Homo sapiens
caccagcgtcggtggttgcgtatctcctgccactggctgccgactacagttcatttatctggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297236 - DNA, 3513 bp, Homo sapiens
ccaacaattaagctcacctttgctacatactttatagtttacatcataccatcctaaatatattttcttgatttgggcataatccattgggccacttttgtggaatacacttgttagtgtactaaatagacaaaaacctacacagagggagactttgtaagaagccaaagaagagctgatatcctctccttcaactccttccattctctgctcagaataagatgggggaaaagaacaacatgtgcaggctgatggggagactccaagcccttggagtctggccctgatggctccagctgcaggctctgtgacattaggaaagctccttttcattttctgaagagggtaaggtgatgcgtgtaaacttcactccccatcctggctgagaccccgggaagaaggcttctcaggccacgcaaggctcttcctgcgtggccatcctcccatcccatctctgtctgtgcttccagagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297237 - DNA, 2508 bp, Homo sapiens
tactctagaggatcttatcgacttctgctctgcgtcgaccttctgttctggttgaccttctgctctgcgtcgaccttctgctcctgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297238 - DNA, 1754 bp, Homo sapiens
atgcttcgccaacacggtgctgtcgggcggtaccaacatgtatccgggcattgccgacaggatgcagaaggagatcacctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297239 - DNA, 1633 bp, Homo sapiens
aaatttctcctttagataggaacataaccaaacaatactaatctgaagcatcatatgtcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttgtagagacagggtttcgccatgttgacgagactggtctcgaactcctggcctcaagtgatctgccgcctcagcttctcaaagtactgggattatataggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297240 - DNA, 2777 bp, Homo sapiens
  misc_feature (2767)..(2767): n is a, c, g, or t
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcaatggtcccgcctgtcaatggtccngcctggtacc

SEQ ID NO: 297241 - DNA, 2956 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcagatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccacca

SEQ ID NO: 297242 - DNA, 2375 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagtcaccgtcgaaggagatcctctaga

SEQ ID NO: 297243 - DNA, 1588 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggtaggagttgacagggagggagaaagctct

SEQ ID NO: 297244 - DNA, 1506 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaagctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagctgtgcggccgtggcacgagtgcgggcggccagtgatggacagtatgagaagctgtgcagccggcccagtat

SEQ ID NO: 297245 - DNA, 1007 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcaacaacttcccacagcagcccaggttcaactgacacagcactgtcccctggcagtaccacagccttatcctttgctcaagaatctacaaccttccacagcagcccaggctccactcacacaacactcttccctgacagcaccacaagctcaggcatcgttgaagcatctacacgcgtccacagcagcagggctcaccacgcacgacactgtccaccgccagctcacacaagacctggaattcaggaagaatcgaccgcgttccagaccacccga

SEQ ID NO: 297246 - DNA, 328 bp, Homo sapiens
cattcaacaggatttatgtcagttgctggagatacaaagccaaatagatgtcacagaaactctaaggtcaactagtcttggaagacaaggggcgcttcatctccttgtgattattgtttttcagcattgcacaggagaagtcggcctgagtggtgcggcgctcgggacccaccagcaatgctgctcttcgtgctcacctgcctgctggcggtcttcccaggtgtgtctgccaggccccaactctccaagctccaccccttcagcctgcccgactccagggttcacctccctggggacactaaaatcagactcatccccagggatgtcc

SEQ ID NO: 297247 - DNA, 453 bp, Homo sapiens
agcagcccagcctggccttctaggtcccagcccctgtccttacaccaactcctcttcctcccggacagaccgagtttcaatcagaagctacaggacagacattagcatgtcagacttcgagaactccagggaatttggagccaatgacaacatgggagcctcttcgatcactcaggagacatccctcggaggaaaagaaggtatgaccctcactcaagggaatgctcagcccctggggagagtaagaattggtctcacatctgggttgggaaaaggaggctagtaagggctaacctaccctctttcttcacacagagtttgttgccaccactgagagcaccacagagaccaaagaacccaagaaggcaaaaagggtgaggaggaagaaggaagccccactacatgacaaagaaatgcagcatgaggggatgcagttagacttcagaaagaact

SEQ ID NO: 297248 - DNA, 3988 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297249 - DNA, 3986 bp, Homo sapiens
aggcatcagcaatctatcagggaacggcgggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297250 - DNA, 3856 bp, Homo sapiens
ccgtaaactcggctaggtacgaggcctgggtgtaaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297251 - DNA, 3934 bp, Homo sapiens
cgattctcgccacgtcgtgccgtcgctttcttcgctttgccctcagcctcgctggtgagccaccaagcgcgagcgcacttttttagtctgctcggttccggacttgccgcacaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297252 - DNA, 3946 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297253 - DNA, 3771 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaattctaactaaaaaaaaaaaatcgggcttttttggggggaaaaggatgatggctggtacttgtttgcctttgtcaaggggaatgcggcccaaaggggtatgaacga

SEQ ID NO: 297254 - DNA, 3681 bp, Homo sapiens
tgaaatgatacctttagtacatatttaattcttacatatacttgtgtctgacttatatcaaaatatttcctttaattcaacactttggtaaatagaagtataatggaaattagaagccttagtgagacgtcagtatgcttccaggcttttaaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297255 - DNA, 3592 bp, Homo sapiens
acctggccagtaggtgtatttttatagaattgctgcattcactaatttgtaacttttggatacctgacaataactcatagcatcctttggttcatcaaatattcatcttattatttttaatggctacttagctttccattgcatcattttttgtttgtttgtatttttgagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297256 - DNA, 3373 bp, Homo sapiens
aggcatcagcaatctatcagggaacggcgggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297257 - DNA, 3932 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297258 - DNA, 4415 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtatcctttcttgagtatgctgtgtgagcacaaagggatgttctcgagctacagagtcacttatgtgctgtcagattacctggggcagacaaggattagaggctgtcctgtagtgtgtcccatggtgactgtttcccttctgtggtccctccctgtgcatagcctggcttacagggtatgagccttcccccagtttccagaggatgatctcctctcctcagtctgcctgaagaagacttagagtaactttcaggctggcattgagcatcctgccagccccggggagatgaggcaacccagccccatgaagaggccttagagtgactttcaggctggcactgagcgtcctgccagcctgggggagatgaggcacatgtacataccctctgttgtatggctgttggctccttaacaagcttcccctcaggtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297259 - DNA, 3959 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297260 - DNA, 1878 bp, Homo sapiens
ggtgtcctcaggaaatcccagcaggctcctgactgctcctgttgggggcctgagggtgggctgcccggtccagctctcctgcgatcacactgcacagtgcccagctttcagagcgaaatcccctgtctcctcagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297261 - DNA, 3136 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgacttgaagcagcttcaatatcagaagttacaggcagaacgtgtcaagtgggcaatacctgatctcagtacataatcggatgggtaaataccctgaacggatactggtggatgaacgtatattaaagaatggagaatgacgaattggagatgggaagaaattagagacggga

SEQ ID NO: 297262 - DNA, 1850 bp, Homo sapiens
  misc_feature (204)..(204): n is a, c, g, or t
actatgatctttgatgtggaacgcgtgaccaatgccgattggtgaactttgacatcgatcttctacaagatgcactcttggtcatgattagtgcttggcttatcacgcgacactaaataatcgactcgcgtcgagtagccgtcccgtacgtgcaagcagatactccaaggatcggacgattcgtagatcgttcagtatcctggnatctaactcaaaatcgacgttctctaacagccacgtgatctcaccctcacagattatcgcgcgccgaaccgagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297263 - DNA, 3126 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatc

SEQ ID NO: 297264 - DNA, 1459 bp, Homo sapiens
tgagctcattccgtcctcatggcagctccatgagactgtgttccccatttgagaaaagaggcaagtagagtccagagaggttacgtagcttcttgcagctccttggcacctggcagagctaggatctgacagcctggcttgtgagctaaaactttggtatttcctcaccatgggcattgtgagaattagaagtgatggattgcagcacttagctgggtggcttgctcaagttggcactcagtgaacagctgctcctaatttcccatcagaagattctcagctctcccttttccgaccttccagacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297265 - DNA, 1234 bp, Homo sapiens
cagctgcagaggctgcaggcccggtccccagtcggctagaatggacccccgcagctcggggagggggaggccgctccggctccagtcgtctctgtcgccctcaggtattccgttgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297266 - DNA, 1135 bp, Homo sapiens
agtcacaccattgcactccggcctgggcgacagtgagactccatctcaaaaaggaaaaaaaaaaaaaagaaagaccacatggacccaacatcaaatagagctcatctccctggaagctttgccacatctgtactcacagttcatgtcacttgtgacttctgtttttcaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297267 - DNA, 1449 bp, Homo sapiens
  misc_feature (1429)..(1429): n is a, c, g, or t
  misc_feature (1445)..(1445): n is a, c, g, or t
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgatcttgactcgggggatcctgngggtaccgagctcganttcg

SEQ ID NO: 297268 - DNA, 1562 bp, Homo sapiens
agtcacaccattgcactccggcctgggcgacagtgagactccatctcaaaaaggaaaaaaaaaaaaaagaaagaccacatggacccaacatcaaatagagctcatctccctggaagctttgccacatctgtactcacagttcatgtcacttgtgacttctgtttttcaggtttgggcaaaactacccctgatccttcagctaacattagtctggatggtgtagacgttcctcttgggaccgggatttcatctggtgtgaatgacacctctctactatataacgagtatcctttcttgagtatgctgtgtgagcacaaagggatgttctcgagctacagagtcacttatgtgctgtcagattacctggggcagacaaggattagaggctgtcctgtagtgtgtcccatggtgactgtttcccttctgtggtccctccctgtgcatagcctggcttacagggtatgagccttcccccagtttccagaggatgatctcctctcctcagtctgcctgaagaagacttagagtaactttcaggctggcattgagcatcctgccagccccggggagatgaggcaacccagccccatgaagaggccttagagtgactttcaggctggcactgagcgtcctgccagcctgggggagatgaggcacatgtacataccctctgttgtatggctgttggctccttaacaagcttcccctcaggtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297269 - DNA, 922 bp, Homo sapiens
ccaccacttcgtccactatgatctgacacaagtcatggtggacgaagttgttgcgcgaccacttcgtccattcagacctgccaccacttcgtccaccaggatatgacttgaagaagtgtatggtggctcggcgtgtgcatgcacacgccgagtgcccatacacgccgagaatcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 297270 - DNA, 692 bp, Homo sapiens
aactatcgggctaggtacgaggcctgggtttggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcagacctcccccagcttgccctctcccacatgtgcagatcaagcgtatggtgcccatgttatttcagcaacacctcctggactcagcatcatctgttgcatgatatttggtattttgtttttccagatgcttggaatgtagcctttaaagtta

SEQ ID NO: 297271 - DNA, 940 bp, Homo sapiens
ccattgtcctcagcccattccctgcagtgttgcaggggtttgggtgggcgagagtatgttgagtctggtaccaggtgtttacatcgctaaagaaagagccttggcttctttcctaggacaaagtatagacctatgggtccaagcagggtaagacaccacatgtcatttgttttgcccctagagcaccttcctgatgggaaaactgtaggtgtggttcttcgtgaagggattcttattctctttttacaattctgaagccttttaattaaaagacagggaggtagaccagcattctaggttttctgaagtttgaatataaatatgaaaataaaacataactagtctcctccgtaatactcaggcttactgagcatagattacatcagctatttgacagatgcttgttaggcctgtgctctgagccagggataattttcattgcacatcatagctgtgacttcctctggcccattgtgttttaactcatgctgagctggactctcttccaggagccaattgcttgttctggagatgccctgttcactgacagtgaatcccacattctagcttccctgatatcccaaaacatagaattttaagacaaaaaggaaccctgagattctctagcagcccaagtagatgaagaggtggaggcttaggtaagtggagccactggcccaggatctgcccagcccacaggcctgggacacaggctctcggtcatgcccggcttcctttgaggagtgtggtgttgagctatgcattgactgagcctgagcattcctcctctgtagctctcctgggtctcttttgtgctaatcccaagattctgtttatccaggtggttgacagagattctgaagaagccgagatcatcaggaagtatgttaagaacactcatgcaaccacacacaatgcgtatgacttggaagtcatcgat

SEQ ID NO: 297272 - DNA, 745 bp, Homo sapiens
ccgtttagtttgacaaaggaggcagcgaggccgtctcattggtagccctctcctggcttgcccagccaccacctcacctcgattcctcccaggcctgggtccagcaccagcctaggaagagggtgccccatgctgtctagctcttcttcgggatggggggctccaggttccttggtattttgctttggcctttggagcctcagtcaaaactgaggaaaggtgtcattttcacatctcgtcacacgtacagtgactgcaactaaaagcacaggctttgtagaaacagacatgggttcaggccccagctccaccattcacaaggtgtgtggcttcctgcaaggtaccttcatctctgagttacctgactccatctgagtttccttcttgtaaaactggcatccatgaaagtggctacctcgaagggcgtgaagatgaaatgaggtggaaagtaggtagcccccgaatgagggaagcattgagtgagagctggccctctgacccttctaaaagaacacagccaactttttaaactgtctttccagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297273 - DNA, 1314 bp, Homo sapiens
gcttctttatctcgggactctcaggcgcagcgggggcgggatataaagctggttgacgtcaattacaaccactcgtcaagcagactgaacttgaagaactgataactctacgaattgcatctcaagaaaaggctgttatcccagctctctactcccattggatttttgtgagaccttgagggtgggagcttttggcggcaaccaatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297274 - DNA, 912 bp, Homo sapiens
tactcagtgacctcctttagaaagaattgttctaagatttgaaaatcaatttggttaacaaagtgcagaatgaccttttggaaaccagagcactcaccggcctgtttagcattctgttctgccaggtgggaagtcagcttgttcctggtatttttgcactcagggttacaagaggtgagactccacacagaaagtgctggttggtgcgagaacccgtcgtactgcctctctaagactctggagttcgctcctttccccttcatcttctctcgtgcctgggagaaaagacagagcatgtgtgaagatgtgggtgcctgtatttcacccctaagacaagtccagtgtgagttgagagtgataccagtgactcgtagcttgtggtttttccacgtggagacttttcttgcttttctgattgtaggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297275 - DNA, 774 bp, Homo sapiens
gcttctttatctcgggactctcaggcgcagcgggggcgggatataaagctggttgacgtcaattacaaccactcgtcaagcagactgaacttgaagaactgataactctacgaattgcatctcaagaaaaggctgttatcccagctctctactcccattggatttttgtgagaccttgagggtgggagcttttggcggcaaccaatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagttcctgtggataaaaggcttagccgtgcagaagtgtgctctggctgttgtgaggtttgcagatcagtctcatggacctgtgccctgcccgc

SEQ ID NO: 297276 - DNA, 467 bp, Homo sapiens
cacgaggacagagtctggcgcctggtaaacactcagtagatgttagctttcttaaagtataaatattgcccctagaatcttgtttatagtgttattacttactaaatccttgtattcatggcttgtgcagagataaatatcacccttgcctctggtccaattatcacaaatgctaaattaatgaagcccaaatcagcttttcctgtatagagggtttgccatcttttctgcagcacacctttgtgcaaagcagtaggcggtagtgccctagcaaacaggatttcagtattctcccttcctccattcatttgtgaaattgtccctgcaccccaatattccatattccctagaacgcttgatagaactcagaaattaaaacccaccccaacctccaaaacatgagtcaccaaaggccagtgggctacgggttaaactctgttgaggtgttgaagtgggtgggtgggtgt

SEQ ID NO: 297277 - DNA, 481 bp, Homo sapiens
aacatgctctccctttgggggccctcagtgctaacattcttggtgttcctcggcagacaacaggaatggatttggtggtgaagacagtgccagttcctgacacgggagacagtgtggtgagtgatgcctttacccaggggaactcagggctcccccagctgggcccagggtctctgtggtcacaccatcctccctaggagagatgcagtgcaaggctgtggtctagacttggctgagcatttcggaatagaatcgggaagcattcaagggagggactgaggaggtggaggaggaaggaaggaaggaggactaggagatgggcctggcccttgaggaacttgttctctactatcaaggttcttgagtctctttatgggaacctggggctcttgaaagtgaattgcaagacgttatgtttgtgtgtgcttttctagagagagggtttgtagctttcaccagattcctaaagaggtctgcgaga

SEQ ID NO: 297278 - DNA, 462 bp, Homo sapiens
agcacttgctattatctgtgcaagttaactagtcccccctgagttgaggctcacagaagcaccgctggcagctcggttaagaaagctgtaattaaaaaggaaatataagcaaacgcagcttgagacgcagccaagggctggcgccaagctcatctcctcctctcttctgcctaaacaccgcagtgaccatcctgcctacccaaaggaggtccctacaaacaagtgcaagaacaatccgcgctgatcactgccctcccagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297279 - DNA, 560 bp, Homo sapiens
agcacttgctattatctgtgcaagttaactagtcccccctgagttgaggctcacagaagcaccgctggcagctcggttaagaaagctgtaattaaaaaggaaatataagcaaacgcagcttgagacgcagccaagggctggcgccaagctcatctcctcctctcttctgcctaaacaccgcagtgaccatcctgcctacccaaaggaggtccctacaaacaagtgcaagaacaatccgcgctgatcactgccctcccaggcaagcgaggagtggggaagtaacgtttgatgagggcctactgtgtgctaggtgttttgcacacattatttgtttaggcttcataacagccctacaagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297280 - DNA, 546 bp, Homo sapiens
cacgaggacagagtctggcgcctggtaaacactcagtagatgttagctttcttaaagtataaatattgcccctagaatcttgtttatagtgttattacttactaaatccttgtattcatggcttgtgcagagataaatatcacccttgcctctggtccaattatcacaaatgctaaattaatgaagcccaaatcagcttttcctgtatagagggtttgccatcttttctgcagcacacctttgtgcaaagcagtaggcggtagtgccctagcaaacaggatttcagtattctcccttcttccattcttaactctactttcgacggaagcagtgttttaccccgacactggcttgcctaggaccttgtgctctgcacaactagcagggcccggcaggatgtactgaattcttgctctcgtgtccagctggacggtgatggctttcaagtccttggctgttgggagcttactataaatgttcgtcttggctacaaactctccactctttcctcggcactctctcagcattgccaccactgtctttcct

SEQ ID NO: 297281 - DNA, 220 bp, Homo sapiens
gtgttgaaggattcttcatgggtcacatcatagacgagacataagacactgggactctcccacaatttatccagcatttccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297282 - DNA, 1078 bp, Homo sapiens
gcttctttatctcgggactctcaggcgcagcgggggcgggatataaagctggttgacgtcaattacaaccactcgtcaagcagactgaacttgaagaactgataactctacgaattgcatctcaagaaaaggctgttatcccagctctctactcccattggatttttgtgagaccttgagggtgggagcttttggcggcaaccaatcgagggtcagcgaggaggaggaggaggcggggcaggtgggctatggttgcttggagagtgcatccggcccggtacttgtgatcggaggagagccggatcgtccttccttgaaccctctgggccagcccagggcccgaagcccacccactcgcgtctctagcagccgctcttgtcctctgggtacggctcgcgggagtgttggttaccatggtgaagctggcagccaaatgcatcctggcaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297283 - DNA, 1204 bp, Homo sapiens
gcttctttatctcgggactctcaggcgcagcgggggcgggatataaagctggttgacgtcaattacaaccactcgtcaagcagactgaacttgaagaactgataactctacgaattgcatctcaagaaaaggctgttatcccagctctctactcccattggatttttgtgagaccttgagggtgggagcttttggcggcaaccaatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcaaaa

SEQ ID NO: 297284 - DNA, 1188 bp, Homo sapiens
gcttctttatctcgggactctcaggcgcagcgggggcgggatataaagctggttgacgtcaattacaaccactcgtcaagcagactgaacttgaagaactgataactctacgaattgcatctcaagaaaaggctgttatcccagctctctactcccattggatttttgtgagaccttgagggtgggagcttttggcggcaaccaatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcaggagacccagcagtgggcaagaccgccctggcacagatcttccgcagtgatggagcccatttccagaaaagctacaccctgacaacaggaatggatttggtggtgaagacagtgccagttcctgacacgggagacagtgtggtgagtgatgcctttacccaggggaactcagggctcccccagctgggcccagggtctctgtggtcacaccatcctccctaggagagatgcagtgcaaggctgtggtctagacttggctgagcatttcggaatagaatcgggaagcattcaagggagggactgaggaggtggaggaggaaggaaggaaggaggactaggagatgggcctggcccttgaggaacttgttctctactatcaaggttcttgagtctctttatgggaacctggggctcttgaaagtgaattgcaagacgttatgtttgtgtgtgcttttctagagagagggtttgtagctttcaccagattcctaaagaggtctgcgaga

SEQ ID NO: 297285 - DNA, 1005 bp, Homo sapiens
gcttctttatctcgggactctcaggcgcagcgggggcgggatataaagctggttgacgtcaattacaaccactcgtcaagcagactgaacttgaagaactgataactctacgaattgcatctcaagaaaaggctgttatcccagctctctactcccattggatttttgtgagaccttgagggtgggagcttttggcggcaaccaatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagatactcgctgagcacctactacgtcagagtcaccgtgcaaggtgcagtgggcctgcaagcatgagtcagttgcactcaaggaagaactaagatgcgtgtgatacgttctaacacagcgaacacaaagtgaatgccctttgtgtgccagatgcggggaaatgcctccaggcacagctgctacttgttctggttctggagaagaaagaaaacaacatttgacattgatctgtattttgtttacttttaaaaaaacacttaaatagtacttatatatgccaggcactgtgcatattaactcattaaatcctcataacaattctgt

SEQ ID NO: 297286 - DNA, 689 bp, Homo sapiens
tgctaggtgttttgcacacattatttgtttaggcttcataacagccctacaaggtaacactcctgtgttgtatagatgacagactcagaaaggttgtgtagcttgccctggttgcatagttaaacgagggctagaaacaggactaggagtcaggcctgtccagctggaaaacttgggttttctagaaggggtaccctggcctcctgcggagcctgctgtgggactctgcagaacacaattcaaggccagactgaacactagcctgaacctgccctgagaatccctctaagccgacctactccacagctgtcctgactgtgtaagcgagatgatgattagtgatcagacgaaaggattcctgtcattggtaaccctctcaaagtatttggaaaacagttcaattttcatctatttcagaagcacgccgtggtgtctattgaggctcacctgcattgaattccttcctttttatgttgcgatctcccaagattgcattgtggagtgttttcgaatccattttgaaatccccgtgcgtgcgctatgcaggcctcagtctttttccattccattcttaactctactttcgacggaagcagtgttttaccccgacactggcttgcctaggaccttgtgctctgcacaactagcagggcccggcaggatgtactgaattcttgctctcgtgtcca

SEQ ID NO: 297287 - DNA, 3799 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaaggtaatactcacagcagaagagccaggtgccggggcagacacactaactcattcttcaggaagcctggtcagacctaagttctttccacttgatctggaattttaagtacccataaagaaaggtcatcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtcaaactctcgatcactagagggtgatgtggcaaatgccatcccatcaacagattgacatgatcttttttccaaagggcatgtcaacttttttatcatgacaagattttgtccaaagctagactttgatgggagcaggcaagaagtaacatttcctgtgtccctactatgtgtcagacatcttctgtaagtccccacactatcctggcaagaaaagcatgattatcccagttctatagaagagaaagtagggtcaaagaggctaaggaactagcctgggatcacagatttttaaccgtagtctgtctccaggatcacccgcaggagtaactcagctcaggaagcagctgctgacgtgcccagcaactcctcaccccagctttctggcttggttactccattagtccccaccagcaccacttcctcccagctcttaaagattctattcccaagtccatttctttcacatctagaaacttaggcttctttccttccgttacttccagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297288 - DNA, 713 bp, Homo sapiens
ccgttctgtgcttccttttccctcgttgccagcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297289 - DNA, 787 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgtt

SEQ ID NO: 297290 - DNA, 416 bp, Homo sapiens
gcacgagctgctgtggcctgctggagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297291 - DNA, 460 bp, Homo sapiens
cgggcgggcaggcgggggctccgcagcagcagaaccgatgccacccgcctcagacggccagccccagccgccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297292 - DNA, 745 bp, Homo sapiens
  misc_feature (713)..(713): n is a, c, g, or t
  misc_feature (716)..(716): n is a, c, g, or t
  misc_feature (741)..(741): n is a, c, g, or t
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttccccccccccatgttttttttnccnaagaaaattgttttcttgttactgnttta

SEQ ID NO: 297293 - DNA, 2503 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297294 - DNA, 2626 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297295 - DNA, 1179 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297296 - DNA, 1869 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297297 - DNA, 1928 bp, Homo sapiens
  misc_feature (1087)..(1087): n is a, c, g, or t
  misc_feature (1090)..(1090): n is a, c, g, or t
  misc_feature (1486)..(1486): n is a, c, g, or t
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataaaaanaanaaaaaaaaaaaaaacaaaaaaaatttgttcgcgcgcgccgcctgggggccctcggaagaaagttttatagaaaccattccgtgttggggacccgcggggccccacagagaggatagcgcgaacctgtgggccacaacggtggtgcccaaagggaaaaacacatggggcgcaaaaagacaaaaatgagggcatgggagcattcacaccgcacaaataaagaaaccgccaccggaggggaaaaacacagagaagcgcgtgctaagagacaacagtacccaggaagggggaagacaccgacagaagggcacaataacagaggagcatctaacacaaaacaaacgagggtgcaccaaaaacggggaggcaccaaagaaaatatcacaaaagtaagagccnccccaagcatgtgggggaacaaacgaacaagacagaggacgcggcgcgaggaggaaagacgagcaacaaaaagccaacacgaaaaggacgaaaacaaaaacacaaagagaccaagaaaaaacagcaagaacaacgaagagaaacaagacaacaagcaagacaagccgaaaagacgagagagagaaacagagaagagaagaaaagaacaaagggaagaaacaagaagagagagaaagaaaaaagaaggaagagaaagaagaggacaacagaaaaaaaagaaaaacagaaaagagaaaaaaaaaaaaaaaaaaaaaaaaaaaaactggttggtatctctgtcggggtctgcatctgtatatatggaacaactaagcccagttgtacaatgtccccctccctgctatcctaaaaaaaagcccagatgccttaagacttgtaaaaa

SEQ ID NO: 297298 - DNA, 2985 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297299 - DNA, 2256 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaaggtaatactcacagcagaagagccaggtgccggggcagacacactaactcattcttcaggaagcctggtcagacctaagttctttccacttgatctggaattttaagtacccataaagaaaggtcatcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtcaaactctcgatcactagagggtgatgtggcaaatgccatcccatcaacagattgacatgatcttttttccaaagggcatgtcaacttttttatcatgacaagattttgtccaaagctagactttgatgggagcaggcaagaagtaacatttcctgtgtccctactatgtgtcagacatcttctgtaagtccccacactatcctggcaagaaaagcatgattatcccagttctatagaagagaaagtagggtcaaagaggctaaggaactagcctgggatcacagatttttaaccgtagtctgtctccaggatcacccgcaggagtaactcagctcaggaagcagctgctgacgtgcccagcaactcctcaccccagctttctggcttggttactccattagtccccaccagcaccacttcctcccagctcttaaagattctattcccaagtccatttctttcacatctagaaacttaggcttctttccttccgttacttccagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297300 - DNA, 2599 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297301 - DNA, 1169 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatgtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297302 - DNA, 2574 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtagggacaaaagaggggacgcgcggaatgccgactcagcggaggcctgggctggaggggcggccgcggggttctgcgcagctaggactgggagctgtgccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297303 - DNA, 571 bp, Homo sapiens
tactcgagtacagttctgaggtcatacacactattcacagagtatacattaactaggttgaggcgataaaagtgggctgaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297304 - DNA, 1031 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297305 - DNA, 583 bp, Homo sapiens
acccccctaaaaatctcataaactttgagtggtattgagaaattgtagggtgaactgaaaaaggctcatgggattttagagccaagaaggcctgagtggcagttcctaccttagtaggaatagcttcagtggtgtgttgcaggtggaacccagattaaagtgggttaaaaagtaaatgaaggctaggaagataaatttttcaacaggtttgtctgtgaagagtccaggctattagatttttagtgttccccctctctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297306 - DNA, 828 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccagtaagtctctgctctccataccagtcagctgggacatttggcagtaatttcaacttggtttgcaacagtccttttagatcatggagcccacgtttgtaaccctcagaattagagctcatgagtctgtccttataacctgcagagggttagagcccccatggtctcacattcatccctaagagaatcatgccagaaggaggtatgcaccagccatcatactgagcacttcatgggcgtaatttctaaacctcacaaatatccttgagtgcacagtagatgtcattacttccctcttatgga

SEQ ID NO: 297307 - DNA, 1047 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccagtaagtctctgctctccataccagtcagctgggacatttggcagtaatttcaacttggtttgcaacagtccttttagatcatggagcccacgtttgtaaccctcagaattagagctcatgagtctgtccttataacctgcagagggttagagcccccatggtctcacattcatccctaagagaatcatgccagaaggaggtatgcaccagccatcatactgagcacttcatgggcgtaatttctaaacctcacaaatatccttgagtgcacagtagatgtcattacttccctcttatgga

SEQ ID NO: 297308 - DNA, 1083 bp, Homo sapiens
agcggagcttcggtgacgtcagagaggcgcgctcccagctcggagccgactcgcagacgcgccccgcccctcggcgtcgctctggactggcgcaggcgcaagccggcaagatggcggcggctggggctggccgtctgaggcgggtggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagatctgcgcatatatatatatgtataaaaaataataaaataatggaagatgatggtgttctctaataa

SEQ ID NO: 297309 - DNA, 1462 bp, Homo sapiens
ctattaaagtcatgatagggttggatagagaagtagagtatagaaacctcttgtttgtcacatgagtctctttaggacagttgtagtaggcagaattctaaaatggtccccaagacttacccccactgtacacaccctgttactgtaaatttgatgtatctactaccttgactaggttacgttttatggcacagttgacctaattatccaggtggacctgccctaatcagatgagccttttaaaagcaaagaattttcttggctggttgcagaagagaaagtcagagagttgaagcatataggccattgctggcttaaagatggacgcaggtatgtagtaaggaatgtgggcaacctctaggagctgagagcagttcctggatgacagccagcaaggaaactgggacctcagtcctgcaaggaaatgaattctgccaacaaccacttgatcttggaagaggacctcaagcctcagatgagaaacacagtccaggctgacaccttgattatagcttggtgagacctttgagcagagagcccagtcacattatggccttacttatgacctacagaaactgggagataataaactcttgctttaaattgctacatttgtggcaatagaaaactaatatctaattccatctctcaaggaatagatagcctaatttcacaggcatactttttttgtaattatgtgtttagcaatttatactataaaatactgaattgttttttatccttcagactaaacaccaagcatcattgtgatgtgtgaagagatgctagttaaaatgtatctgcccttgagagttctaagggtgatctaatttttctgcaaatctattttttaatttttaataatatgaatatgattttttttaaatgaaaaatttaaagaaataaccaccccacaatcatctaccagtgaatgggccagagaagagctgccagacaagattgactacataatcattaggcccagaacacagtgaaaatgcagcatcccttgttcaaaaaaattattaagaatttcaagacacggcagcagagcattaaaccaagagtggggtccttctgaacatggggtcctatgtgatggcacaggtcacaaaaccatggagccaaccagctctgtgcccagaccttctccagcaccttccagataaaagcttaactaagagctacatactttccaaaggcaccattgcttcttcactgggtgacatttgcaaaataattgcccataatgccaccatctaggacaatgagatcctttcagaattttctccaagcttgtatgtgtatatggatgtgtgtttgtgtatgtgtctctttgacacaggtggattgttcttaacaattgttgtactattgtgtcacttaaaattatagcaggagtatttctctgtattaataaatagtatttaagaataaaatttaaatatttaaaaaaaaaaaa

SEQ ID NO: 297310 - DNA, 5619 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacggtaagaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaacaagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtttaaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctaggtcggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaa

SEQ ID NO: 297311 - DNA, 5215 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaacaagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtttaaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctaggtcggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaa

SEQ ID NO: 297312 - DNA, 5920 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacggtaagaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaacaagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtttaaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctaggtcggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaaaaaaaaaaaaaaaaaaaaaaaaaaaaaaaaaaaaaaaaaaaaacaaaaaaaaaaaacaaaaaaaaaaaaaaaaaaaaaaaaaaaaaaacaaaacaacaaccagaagcgacaaccagcacggggggggacgctcagaagaaaaagaagtaaaagagaggagggacggggagacggagtggactaaggtgaagacagacgaatatacgaagtagacgggggtggacacaggcggccgccatctcaagtgcagagcctatagcgtcgaccagagaacaccgacaagaagagaattagcataggg

SEQ ID NO: 297313 - DNA, 841 bp, Homo sapiens
  misc_feature (23)..(23): n is a, c, g, or t
cctagagtacccatgcaataacntcctctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaa

SEQ ID NO: 297314 - DNA, 1151 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacggtaagacggggctggcggggcgagcgccaacttcctccccgacggggacggcgcggtggcggggccctgggtggcgcgggcggtgcgtggacaatgcgagagtcaggaagtgctcaccccgcccctccgccccgccgcggctgccccttcgcggtccccacgcctggcggcggggacagatctgcggcccctgcccggtgtccgcgcggggggcagcccgcgccccacactctgaggggctcccggctgcggcagcgctgccctcgggcccagcctgctgcccgcgctggcactgccccgccgtgtgtgccgggccgaagggaggaaggaagggaggaaagagccgcccaagttgagaagaatgatccgattgaaaacttaggcaccggttaattcttcccggtgctccaaggccacccgtaacccccggaatgaaggagagagagcctcaattcttagcacacccaggcttgctgcgtcgatcgccacaggtgaagaggcctcgagacatttagggcctctgtgtttgctctttaattttttggcttgcttgaggaaggaagagaatctgaacttgacttccgttctcagcccg

SEQ ID NO: 297315 - DNA, 842 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacggtaagccgaagggaggaaggaagggaggaaagagccgcccaagttgagaagaatgatccgattgaaaacttaggcaccggttaattcttcccggtgctccaaggccacccgtaacccccggaatgaaggagagagagcctcaattcttagcacacccaggcttgctgcgtcgatcgccacaggtgaagaggcctcgagacatttagggcctctgtgtttgctctttaattttttggcttgcttgaggaaggaagagaatctgaacttgacttccgttctcagcccg

SEQ ID NO: 297316 - DNA, 1130 bp, Homo sapiens
cagctcctaggctcaagtgatcctcctgccctagcctcctgagtagctgggaccacaggatctcagggacaggccccgtgtcctgctgaccctctcaacaaggcacccgcttaccttgggtttattgcagtgcgcgaccactcgcaagattcttctcttcagatcttccaagttggtcacactgagcctgtttagcaaaggggcacactgaggctgggacctggcactcccaaccccccagccctgggcacagcaccaggtgggcttacctgggaatcacatccttccccaggacgagtgacacgatgaagctctgagaatattcctgcagagctttgctgaaattccaaacagagagaggatgttagctttacgatgacactgcccacaagggcttccatgaaagaaatcagtaacactgaggggttaggttcccaggcctcagctctgttctctcttctctaaagggagggtaggggaaacgtcagttatggcaactcactggccagatcctactaaagccacaatatgtgttcaacagagacgccccgcagctaaaaccgcaaactggacaccaaggcggaccaagcacatggatctgtcctttgacccagaaaccgcgcttggaagactccatcaaagatgcactggaggccgggtgcagtggctcacgcctgtaatcccagcactttgggaggccgaggcaggcggatcacaaggtcaggagattgaaaccatcctggctaacacggtaaaagcccgtctctactaaaaatacaaaaaattagccaggcgtggtggtgggcgcctgtagtcccagctactcaggaggctgaggtaggagaatggcatgaacccgggaggcggagctggcagtgaactgagatcgcgccactgcactccagcctgggcgacagagcgagactccatctcaaaagaaaaaaaaaaaaaaaagatgccccagcaaaaatgaaggggcagaggcaacaggcgattcactgcggcagaacctgcaccggcagaggctggagcctccaaacacccatccacagaactgccttcagctcccaacaacgagtcacataatagtgcgtcccgcacagctgggagaaggaggaggactgtgtgtg

SEQ ID NO: 297317 - DNA, 4253 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297318 - DNA, 330 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagtttttcatttctaagaagcaagttttcaaagaaaaaaagaaaaaactttttttctgtaatgcagaaatagcaagtttgaagaacaa

SEQ ID NO: 297319 - DNA, 4674 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagcaaacttatgtatttctcttgtcttccttaaaagtgtccccatgaactcagtgtttattcccttttcattttgagtacctgcttatatggtcagtatgtaacgttagcattggctcctaatggtagaattagaacagcaagattgtagagctgtaattgactccagacaacatagatttcagccacctcattctacagctgaggccaggacaataaatgcctttcccagactgggtagtggcagatctgggatggaatatggttttcttgattccctttcagccttcatttctctctctcaggactactactttttaattacttttcacttaatttcccaatactgatgaaataaagaaaaatgagggttatttatatacatttcaataaaatccaatttgatttttcaacttaaaaaaaaat

SEQ ID NO: 297320 - DNA, 4158 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaagcctgtcttctgagtaatgggcagagaaggaccagggttcgtagaagaagcatgtggcagctgagtggcagcagtcttgccctttcattttaatacttgagtacacagaaaatagaatttttgagtgactctgcctgtggatatatatactcatacatacatatatatatatacacacacacatatgtatgtatgtatgtattactattcagtctcttaaaaaccaaaaaacagtagatcccctgagggtagagtctttatgtatgaacatattgttcactgttgtaaccaccttgcaggatttcagtctataaactaggtgagaatccagc

SEQ ID NO: 297321 - DNA, 3617 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcgggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297322 - DNA, 4163 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297323 - DNA, 4199 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297324 - DNA, 3093 bp, Homo sapiens
gaacagagagagcctgctgcctccacctcttgttctagttcgcttttatatgccaagagggacaaattgttcctctaatttgataggggtaatgaggcttattctctttgaagggtcatgaatttctttggcaagtttgtgatgacgaaagggatatctagaatattgccattaggaaaatccaaacaaattcccatcttttatgtaggtttaaaaattttttttgatagggggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297325 - DNA, 3491 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttatta

SEQ ID NO: 297326 - DNA, 4096 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297327 - DNA, 4212 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297328 - DNA, 1640 bp, Homo sapiens
cagaatcgttatttttcccccttagttacccacaagatggcagtatgtcatctgcttttgaccaaagacccttggttcttgcacactgtttttgtgggaatgcctttcacagtgggagtggtagggactttgaaatgccattctttcctgtatccctgtcaccaaggagaattgcaacacagctattttggagctaatcagtattcatctagtttttaaggacagctctgagattacgctgctttatttattacactgagattacattgctatcatttgcccttcttagatagagttgaatagaatagaacctgcattttcaaccattgtgcatagaagttaatttcttctaattgtctcttaagtaaatatgcttttccttttcatagggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggatacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagca

SEQ ID NO: 297329 - DNA, 3153 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaatgaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtgtgagtttatccttattgaatgtataaattctgaatgtttgcattctca

SEQ ID NO: 297330 - DNA, 1570 bp, Homo sapiens
tggccaggagcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggtacgggtgctttatttctttatgagtttctttaaaaaatgtaggtcctatatacattggtgagtaacatcattcacagtggagcggactttacttacaagacagcttgttttgatgctgttcacagagaagattactttttaagtggtgtcatcactcatgaggtgctaatcgtggcatctgtgtctaaagatagaatatgatttgcagagacacatcacagatctaataaggtgcttgtgtcaagccttcaatagaacctaggccgctgggatttgttgttgatagaagatgccaagcatatggacattttcaaattagtattcagtaaaaggcttgaaattaacctctgatttgtgaaaataaataaatagaattggaaaaagtg

SEQ ID NO: 297331 - DNA, 2290 bp, Homo sapiens
cccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaa

SEQ ID NO: 297332 - DNA, 2397 bp, Homo sapiens
cccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagttataaaaaaaat

SEQ ID NO: 297333 - DNA, 1115 bp, Homo sapiens
cccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctgggtcagagcgacttctccagcctgcgcagggggtgttagtcttacccagagggtccagagctgccgttcaacaggatgtcccagattctcagatagggcccaactaccctaagcatacctagcaagggcaggctgcggcatggaagtactgggctaggcgtttgggtgacctgggtcataatcctggctcggaaagggcgcgtaccctttggcgagggatgcgggctggtaccgtgaggtttaagaagcagaaaacatgacagcctctttaagtagccctgggtacgtcacttgaccccagtgagcctcagtttccatatccataaaatggcgatggtaattatactagcctcacagtgtctgatgagatctctggagcctatttatctcacgggaaaatttttgaagagtgaaactagttgatctaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcccctcagcttggggccatcggggaagtctctggcgcggctctgggtgtgacctttgtctgggcctgtactgtta

SEQ ID NO: 297334 - DNA, 2841 bp, Homo sapiens
cccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctgggtcagagcgacttctccagcctgcgcagggggtgttagtcttacccagagggtccagagctgccgttcaacaggatgtcccagattctcagatagggcccaactaccctaagcatacctagcaagggcaggctgcggcatggaagtactgggctaggcgtttgggtgacctgggtcataatcctggctcggaaagggcgcgtaccctttggcgagggatgcgggctggtaccgtgaggtttaagaagcagaaaacatgacagcctctttaagtagccctgggtacgtcacttgaccccagtgagcctcagtttccatatccataaaatggcgatggtaattatactagcctcacagtgtctgatgagatctctggagcctatttatctcacgggaaaatttttgaagagtgaaactagttgatctaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaa

SEQ ID NO: 297335 - DNA, 2051 bp, Homo sapiens
tggtccggtccggaagtgttaggatcgcgggcgcgtgggccccggatggaggagctgagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaa

SEQ ID NO: 297336 - DNA, 2095 bp, Homo sapiens
ttacctgtaagcaaagtgtgggctacacacatctgtagtcgctgaggctagagcttgactcgagagaggaaaggaagaatgcaagcatggtcaagtggcagagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaa

SEQ ID NO: 297337 - DNA, 2486 bp, Homo sapiens
cccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctggaggcctgagggagctcaatcctggtagcaacacccctgaattcctggtggtgaaaggatgtggccccaggacccatcccggaaggaggtgctgaggtttgcagtcagctgccaacaatagaaggcattagaagagaccttccatatgcgcccatcacattcttcagcctacctatgtctgcacctttgtgctttcagtactgaaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaa

SEQ ID NO: 297338 - DNA, 2022 bp, Homo sapiens
cccggatggaggagctgaggttcggtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggtgaggtggattcctgactgggataaggatgtgaatacaggcaaaaccccttggccaaggacagggaaggcagctaacatctcccgtttgagtgatccatactgaatttattcaacagtccacacaagatggtataggcctgaacagtgtagtggcagtaataaagtgggaccattttttccaaaaaaaaaaaactcgtgccgaattcggcacgagctcgtgccgaattcggcacgagtctctctatagttctgtgtcataaagctgtcctggccagccttcaagctggtgtggccactcttgatgtgaggcgtgtcagttccagtggggacatgggaggggctgaacagtggcccaaaggcattcttggtttcacctgcaggtgcatttgggtccatttcatggccaagaaagctctggtggctggacttcttaaggcttggcgtaacaataaactttcgaagtcc

SEQ ID NO: 297339 - DNA, 355 bp, Homo sapiens
gtaagtgtcctgccagttaagagtctgtgatttggcaaaggggttgttgggaagtgaggtgggcaattagctgagagggagaattgactagctttgtttttacttggtttacctgtaagcaaagtgtgggctacacacatctgtagtcgctgaggctagagcttgactcgagagaggaaaggaagaatgcaagcatggtcaagtggcagaggtgggttaggtgcttttctgatcccagcttctcttctgcatgcgcgtgggaagccaaggaagaggaaaaaagagtgaattcgccctaggatagggaaggagtagccgcgtgaggttgagtatgcccatttccgtgatttctctc

SEQ ID NO: 297340 - DNA, 784 bp, Homo sapiens
gttcacccagcagtagagaagtccccgggctggtccaatttgagtcagtgacattccagtaaatgtctggatattcccctctcatgatttctaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcc

SEQ ID NO: 297341 - DNA, 3141 bp, Homo sapiens
  misc_feature (64)..(64): n is a, c, g, or t
tatagaatttcaaaatgaaattatttgcccgacaagaaggcatcattagttagacttgtttccnctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattatggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttcttggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattacgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtacttgagatgtacacaagttaaaggcaaacattgtatatgaaaagtgatcaaaactacatgcttcaagaaattaaaccttgaagaactcaacagttaatgtcatatatagaaaggcaagtcagttaagagtgtaaatagaaacgggtaaatacagaggagaaaaacagtaagcatggactgtcctagaattcagtggcagagcatactgcaagaaagctgatgtggtcaataatatcaaatgccgctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcagccataaaaaagaatgagatcatgtccttttgcaggaacttggatacagctggaggccattatccttagcaaactaatgcagcaacagaaaaccaaataccacatgttctcatttataggtaggagttaaatgatgagaacacatggacatgtagaagggaacaaaatacactgggggctattggagggtgaagggtgaaaggaggaagaggatcaggaaaaataatgagtaccaggcttaatacatgggcgatgaaataatctgtatgacaagcctctctgacacagtttacctatgtaacaaacctgcacagttacccctgaactttaaaaaaaactatgttctatcaaaacctgcctctcatttatgtattaggaatcttgtgacaacggaacagttgaaaaattaaaataaaaattgcctgaaaatgc

SEQ ID NO: 297342 - DNA, 1914 bp, Homo sapiens
  misc_feature (64)..(64): n is a, c, g, or t
tatagaatttcaaaatgaaattatttgcccgacaagaaggcatcattagttagacttgtttccnctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattatggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttcttggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattacgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtactttttttttttttttttttttttttggcatatatatatattttaattgattaaatcttactaatattctgtaagggataaa

SEQ ID NO: 297343 - DNA, 643 bp, Homo sapiens
tgtctgttcctgggtgggctctgagttgatataaggagagggaactgcaataactgaaatgttggagaagcagttagccgttctccgtaaagggtctgccaatcctggttttccatgacttagctatgactgccgatgaattctcaatgctcgtcacttccagggatcttcagatgttaagatgtttggggaaatcacaaagagaagagactgtgttgagacgcattcatccttaagcaaaagctgagagcctgcaaatgctggatgaaagctacaacctttctaaaaaccattaaatacagactttttcaaagagcatccaacaaagtagaatcctgctgtcaagaaaagccaaacttgggcaataggaaaaagtcacgggaaaaatagagtagctcatacaattacagaagtagaatgatttagggattttgagagagtataatccaattattctctaaactattcagggatctattttaatacttgatgatcctgattcttggaggaaagtctcatctgtgcttagttcttgttggtattttttgtttacttggcaacaataatagcaaattggtccttaagagagaacatagagctcttcagggccactgattaagaaggcatattttgaaaaaaaaaa

SEQ ID NO: 297344 - DNA, 434 bp, Homo sapiens
ccggccgcccatcgtctgagatgtggggagcgtctctgccccgccgccccgtctgggatgtgaggagcgcctctgcccggccgggaccccgtctgggagatgaggagcatctctgcccggccgccccgtctgagaagtgaggagaccctccgccctggcaactgccccgtctgagaagtgaggagcccctccgcctggcagccaccccgtctgggaagtctgcctgaacatttccaatattaaagaaaaggtcaaccaaaggtccagatctacaaaatcacctgcatttcatctgaaatgaaattcttgacaatggattcaaatatatacatgctatgatggcaatttttggaaactgccatcacattttcaacaaaattctaagattaatgacatttattaaagaaaaagtaaaagaaataaaaactttctat

SEQ ID NO: 297345 - DNA, 563 bp, Homo sapiens
agataagagtcaggaaagcaccaaatgccgagtgtgaactcattttgctctggaatatatatatgtcccttgcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatga

SEQ ID NO: 297346 - DNA, 338 bp, Homo sapiens
ttctatagtgccctagagtttcggtttcttctaggaggcagtataacatagtacctaaggggacaagctttagattttaaaaagacctacgtttgaattctggctgtatcacttactagcaatataactttagggcaagttctttcacttctcacttctcttagtttgtttctttatctacaaactagggatgatggtattaacccctcatagttcttaagattaaatagggaaggggaaatgtgtaaagcactaagcattgcttggcacgtaccaaacatgcaaatgttacctctgaattgctacctgggggtgggggacaatggtagtagtaacgg

SEQ ID NO: 297347 - DNA, 1866 bp, Homo sapiens
gaaaggacagcaacagtcaggtggtttaccttccagaggctggcaatgctgtttcactggaggacacggctaagaaggaagtccaccagcctgccaagatgaattgccttgaaggagagggagagggatcctggcccagctgactttgaatctgagggagggccaagctgccactgccctggatgttggaacacctggtcttgctgcttcctcccaccacctcaaaaacacagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagagagccccacttcctgctcaccacactccttaggaagtgccagtggtgggtaagtctaaagggttgttcctcctggcttaaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatga

SEQ ID NO: 297348 - DNA, 2063 bp, Homo sapiens
tggtgatgtcggttgggaagtacttctcttcctgcttctagcctgtgcctcatttctgtccctttgtgggacagctccctagagccgagctgggagggtgggtgtttatggcagtctgagaccccaggtctctctcctcaagaccatggccaaggaattctctaaccatcttgctgggaggattccatggctgttttagggtgccatgtcatccttactgactgaggatggtgcctcttggcctctttcttgtctcaggtttaccttccagaggctggcaatgctgtttcactggaggacacggctaagaaggaagtccaccagcctgccaagatgaattgccttgaagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagagagccccacttcctgctcaccacactccttaggaagtgccagtggtgggtaagtctaaagggttgttcctcctggcttaaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatga

SEQ ID NO: 297349 - DNA, 278 bp, Homo sapiens
caggggaaagtcagcattcattaagaccaggaggcaaagccagaattctgaggaaaatgaggatggagcaaattagaacatcaaataaggaatggagagattcaaacggaaaaaaatatcaggagactggaccgtggtaaaggcacaggtgacaacacaaaaagaaagagatgaccaagaggacataatatgaagtattattcaccagtcaaggcttcaaaacagaaatcctatataaatctgaggttcaccctagcctgatgaatggtacagcatgg

SEQ ID NO: 297350 - DNA, 2978 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297351 - DNA, 3120 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297352 - DNA, 2603 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297353 - DNA, 1801 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctgtatgatctcctgtctaaacattcttagagtattatatttactttggggactattggccttgtctgctttgactcagattataggatatataacctggttaatgtttctgtacacatgatggccacctatgtatatacacttgacttttcagggtctctgctggggatggaaaaatagttcattagccaaactctcctaaagtgtggcagatggaggcagtctctcagattgctggatttgtcaccagcttccaagggccattcaagatcattacatgctacttgttgcaccagagattgatttttctgacactccaaatgttaccatatacttacatcagttccctccaaatgtcactttccaaattcaaattcagcttctaaagccaggccatattttcattctgtgcttagtaataagccctaagtctcacccttccccaccgcccccaggtctatctatcagtaagccaattagggacaaattctctaacttatctagaacacaaacttaattcctcatcttttccaggtccctgcacattcctggcctcccaccgttactgtcataactggcaactgaatgtccaaaggagaaaaagcaaagcagattgtgccagcacgtctcatttgttatatatcatgcttatgcaggcctttgtaaggcctgcagtaaaaccaatccatggctcactcatgttttaaacaacttacctattcaaactattatgaatgaatagttaagagatacattttggtatgtggcattgggccacacccaccaactcaaggatgggcacatagtgtaaatagctggcaaaatagctggcaaattgaagggcgcttttttttttttttttttgagggagagtcttgctctttcgcctaggttgtagtgtggtggtgtgatcatggctcactacagccttgacctccctgggctcaggtgatcctcctacctcagcctcccgagtagctgggacaaggagtctgtgcagtagctcacagtgcctgttgcacttacatcgacacctcgggtgaagtagagacttgcacagaaagaatttccaagcaagctaaatggttacaagaggcacaaactactgatcttctcaatgatctatttaattggcttcctatttcttccagtctgcagttcaacccctttttcatgggtaaagtgccgacgtcataacaaggtttgagggaggcacatctcacacgtgtgaatgcccagtcatcacacttacaaatgacaaaaggatctcaaaccttgatatagtctctatcctacttctcttactatcacttaaattactcatggtatttataaccaacttacgtaagtctattgctaaaaccagaattataggtcaggtgcagtggctcacactcaatcctagcacttgggaggccaaggtgggaagactgcttgaggctaggagtttgagaccagtgtgggcaatgcagtgaaaccctatcttgat

SEQ ID NO: 297354 - DNA, 718 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaaggggcgacgacatctgttggggcatccatacggcgatggggaggcccttgacacattctgggcttgtcgacatcctct

SEQ ID NO: 297355 - DNA, 374 bp, Homo sapiens
gctgctgagttgtttgagttccttatatattctggatattaaccctttgagaggtgtatagtttacctatattttctgccattctgtaggttgtctctttactctgtccatcatttcctttgctgtgcaaaagctgtttagtttgatgtaatcacatttgtccatttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297356 - DNA, 3461 bp, Homo sapiens
  misc_feature (3)..(3): n is a, c, g, or t
  misc_feature (5)..(5): n is a, c, g, or t
  misc_feature (3150)..(3150): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaggagctgttttgtggctttgtttgacaggtcttcagtaagaataatgtttttggctttcacatatactcagtttaagtgcttagtattaataacaagccatgaagggaataaattcctcttcactgagacatagactttggaataaaagacattttaactgaanaaaaagaaaaaaaaaaaaaaaaaaaaaaaaagaaaaaaaaaaacaagagaacagcacaacagaagaaaaacaaaaaacaaaaaagaaacaagaacaaagacaaaacagggaggcccacagacaagagaacatcgacacagccggacagggacccgcgccaaccacagaaccgccggcgcgataaacagaaaacaaacgaagctcgccacccaagagaaacaaccgtataagaaaccacaggcgccaggatagatacataaaaacacacgccaagacacagaaacaacacgacagccaaacaaaaggagaac

SEQ ID NO: 297357 - DNA, 3129 bp, Homo sapiens
tgaattacgtcagggcaaagccatgaggaggaacaagccccggcagcgcggcgtgcgggaggcgcggcctgcgggaggcgccgggccgggctggcgcggggcccgttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297358 - DNA, 3271 bp, Homo sapiens
tgaattacgtcagggcaaagccatgaggaggaacaagccccggcagcgcggcgtgcgggaggcgcggcctgcgggaggcgccgggccgggctggcgcggggcccgttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297359 - DNA, 2921 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297360 - DNA, 2297 bp, Homo sapiens
  misc_feature (3)..(3): n is a, c, g, or t
  misc_feature (5)..(5): n is a, c, g, or t
ggnanaggcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297361 - DNA, 3082 bp, Homo sapiens
tgaattacgtcagggcaaagccatgaggaggaacaagccccggcagcgcggcgtgcgggaggcgcggcctgcgggaggcgccgggccgggctggcgcggggcccgttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297362 - DNA, 2083 bp, Homo sapiens
aagcgattctcctgcctcagcctcccgagtagctgggattacaggtgcatgccaccacacccagctaatttttgtatttttagtagagacagagtttcgccatgttggccaggctggtcttgaactcctgacctcagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297363 - DNA, 1375 bp, Homo sapiens
taggactataacacttgtgtaaaaagcagctggtacgggtcggaattcccgggctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactaga

SEQ ID NO: 297364 - DNA, 1435 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttca

SEQ ID NO: 297365 - DNA, 722 bp, Homo sapiens
  misc_feature (705)..(705): n is a, c, g, or t
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaggatcgaactgaagttaaccatcaccagcttgctataggaagacacatagtgcatacttagctgagttcgtgactccactgtgtcttccagaccagtngctgtgatttgagggtt

SEQ ID NO: 297366 - DNA, 2170 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcacaaaaaatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttt

SEQ ID NO: 297367 - DNA, 2200 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcacaaaaaatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttt

SEQ ID NO: 297368 - DNA, 2228 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggtatgtatattaggttaggctgggaagttttttttaaaaacagaaaaacgtgatggaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcacaaaaaatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttt

SEQ ID NO: 297369 - DNA, 2136 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcacaaaaaatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttt

SEQ ID NO: 297370 - DNA, 2174 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggtatgtatattaggttaggctgggaagttttttttaaaaacagaaaaacgtgatggaggattgatctgaagttaaacaaagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcacaaaaaatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttt

SEQ ID NO: 297371 - DNA, 2340 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggtgaggggctaggacaggggttgcacggcatggggctccgcgcccgccccgcctccaggccccaagcccggccgcgctaggccgtttgttactccgggggcgcggcgcggcgggccgggtgctcggcggcctgaggccgggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcacaaaaaatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttt

SEQ ID NO: 297372 - DNA, 1256 bp, Homo sapiens
agcgggggggcgccccctggcggcgcagggaccgcccccaacctcgcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagggtcagtggcagggatcccacccccgcagctcccatgaccattgctgtgaagggaattgcctagaataaaaactctttaggattgctgcagactctttctgttgctgatggcaagaaagtcattaggtccaagtgaacgggctaatttgctcaaagggaggaattggtgggcattagagtaaccctcaaggaagactccaggacattcttctcactgtttctagtgtagaatagttttattccataaaaaccttgtttcatatggtgaatatggaatacttttagaagaggaaaaggagaaatagaaatggaatctgtgtaatagtatttgaaaaatgccactggtacttattgggaagctgtaaagtgggataaagtcttctgctggtaattctgatctttgcctactcttatttctttgtggatggagagaactgatttgacatgcctttttttctctttaaatacaagttttttttattgcttgtgatttttctgtttctgtatttctcagcaatatgctgacttcagatactggaggaacagtataaagcctgtaaaatatgagagtgtcttcataggtaacgtgtaacattggtgcaccatgtttttttgcagtacataatgagataggaatgacgtcagtggac

SEQ ID NO: 297373 - DNA, 824 bp, Homo sapiens
agggggacccagtcaccccgtctggactttggaggctggtggggagcgtgttctttttggtactgggagtagatccgttgaatggaggtttttgatagacagggttgtgatgtgtttgggaacatctagaaggtgacaggcgagggagaagaacacattccggagaattcagaattgtgacaggcacccaaggcccaatgcactctggtggctaagctcttcctgcccccgcgtctcggcttgggcacccgggaggcccctctcacctgaagctgcccttctaggtttccatagcaactggcagcccggtgtcggcggcctctcttgagcctgcggggaggggagcgagttgacgctgaaaggctgctcacctttccctctcctggtagcgataccttttgtgcgtgggagtggacatcgcccaagttctgcgttagcctgggctcttgactcatggtttccgtgaatcctctaaagtatatgcaaaatttcgcgtgtgtgtgtatttttctggagacatgctttatacattcaggggtccatcacccccaaaggtctagactgtcttagtcctaaacggctcctcctccccgtatcttccatctctccacagggtggtttagtgtgggcaagcttgcgtttacgagtctaatatcaggatttcattttggccagacttaagtgtttgcatttaaaaggtatcattcatgtccttgtttttcatctctcaggaaacattggcaaatttggagcgacagatctatgcttttgagggaagctacctggaagacactcagatgtatggcaatattattcgtggctgg

SEQ ID NO: 297374 - DNA, 671 bp, Homo sapiens
tcgtgccgaattcggcacgagcggcacgaggcagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297375 - DNA, 691 bp, Homo sapiens
  misc_feature (8)..(8): n is a, c, g, or t
  misc_feature (12)..(12): n is a, c, g, or t
gaactagnggancccctttgctgcaggaattcggcacgagggcgctcgtttgagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297376 - DNA, 918 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacatttttccccgggaaaatgagcaagcttatgcatgcgggccgttcagctacctgggccatttgcctttagggagggggttacatcggcccggggttcggcgggctgggg

SEQ ID NO: 297377 - DNA, 896 bp, Homo sapiens
tcgtgccgaattcggcacgagcggcacgaggcagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaacaacaaaaacacaacaaaaaaaaaaaaaaaaacctttgtcggccctcttggcccaataagattaaagcctggaacaagtttcgtccctgcgcccaaattgggggctcattgggccaattcccctaaagggggggccttttaacagtccgggggccggttttaacacaacgtggaatggaaccttgggtgtaccttaagtgcggttgggaacttctcttc

SEQ ID NO: 297378 - DNA, 395 bp, Homo sapiens
ggccttggggcatgcgttgcacctgcccggcccggtggctgcgcctccctcctccacctgaccaacgcgacattcctcccctcacgcctggccggtcccttccagggcaactcccaggatgtggtgacatgcagggttcaagtgttcttggttccaggcacctcccggctcacggggaggtgcctgccaaggtgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297379 - DNA, 617 bp, Homo sapiens
ggcctcctggcctgaacagtctcccttcttggaataaggaaatgtgaaggttggagagagatgagaacatttccgaaggatgcacttatgattaactcaaaactagtattagtttgtagtgcagctacggtgttagtgataaggtcttcttatcctctaatttgaccacaacgtttactttctgaagcagttaacaaagtggatttttgtttttttctttaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggcttaggcctgtaatcccagcacggggaggtggaggcgggtggatcactgtagagaccagcctgggcaacatggtaagcagcaagcgggtaacctctaggtca

SEQ ID NO: 297380 - DNA, 749 bp, Homo sapiens
gactgctggggtcccctgatggcttccccggtgcagtggtgtacagttctgtcccacagcattggagaagagcttgtccccggtcgtgaagactgctgcagacatgttgtgtgtacttagttgctgaggagaaaaacaatacagggcacaatttcacgaaactattaggttttaagctgagtgtgtatttcaaagttctgtgatgaattctttcttttcttgtaggttgaaactttttctggtgtctataagaagctcacgggcaaggatgttaattttgaattcccagagtttcaattgtaaacaaaaatgactaaataaaaagtatatattcacagtactctgtttcagttatgtttttcaaaatgccaaattcacggatgcgcagctgtcttcattatcagtggcgtcctgtgtgggccagaggatgtcagtaggaggggtgtctgtagccagaaagcttgatgcctgtgaggttctgcttgtattcaggggtacaagtgtcatcacgtgatgctgcagaaatggctgaatattggcacttttgcatggttcaaactaaaaatatagcaggtactttttttattgtgctatacgtaaaatttaccatattacccatttgtaactttacagctcagtagccttaagtgtatctacaaagttgggaaagggaactctgaacttttttattcatcttgtagaactcaaattacccatgacacccagcactccacttctcattctgtcag

SEQ ID NO: 297381 - DNA, 310 bp, Homo sapiens
gcggccgcctactactactaaattcgcggccgcgtcgacagtttgacgcggattctcttgcccacaatttcgcttgggaagaccaatgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacaacacacacagaaaaagaatgt

SEQ ID NO: 297382 - DNA, 561 bp, Homo sapiens
  misc_feature (519)..(519): n is a, c, g, or t
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaggcggctgctctccgacagaacttttcttcttgggttgaggaaaacgcctttggagtcaggccctggaggggcgagccttgctcacagggtggggatcagccgattacccgccctgtgctttccgatggcttctgcggggcgagcggggcctggccggggggtgcgggcgggagggcgagccagcggcgcctgcagcccgggccgcgtaacgctgaccgctgtgccttcagagttctcccaggagaaagccatgttcagttcgagcgccaagatcgtgaagcccaatggcgagaagccggacgagttcgagtccggcatctcccaggtgagagggtttccctggggtntggggtggggggaggcgccccgcccgggaggggaggcggccg

SEQ ID NO: 297383 - DNA, 1115 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaaaagaaaaaacaaaaaaaaaaaaaaaaaaaaaaaaaaaaaaaaaaaaaaaaaaaaagaagaaacaaagtaaaacaacaaaaacacaacaaaaaaaaaaaaaaaaacctttgtcggccctcttggcccaataagattaaagcctggaacaagtttcgtccctgcgcccaaattgggggctcattgggccaattcccctaaagggggggccttttaacagtccgggggccggttttaacacaacgtggaatggaaccttgggtgtaccttaagtgcggttgggaacttctcttc

SEQ ID NO: 297384 - DNA, 1346 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaggcggctgctctccgacagaacttttcttcttgggttgaggaaaacgcctttggagtcaggccctggaggggcgagccttgctcacagggtggggatcagccgattacccgccctgtgctttccgatggcttctgcggggcgagcggggcctggccggggggtgcgggcgggagggcgagccagcggcgcctgcagcccgggccgcgtaacgctgaccgctgtgccttcagagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaaaagaaaaaacaaaaaaaaaaaaaaaaaaaaaaaaaaaaaaaaaaaaaaaaaaaaagaagaaacaaagtaaaacaacaaaaacacaacaaaaaaaaaaaaaaaaacctttgtcggccctcttggcccaataagattaaagcctggaacaagtttcgtccctgcgcccaaattgggggctcattgggccaattcccctaaagggggggccttttaacagtccgggggccggttttaacacaacgtggaatggaaccttgggtgtaccttaagtgcggttgggaacttctcttc

SEQ ID NO: 297385 - DNA, 810 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297386 - DNA, 899 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaggcggctgctctccgacagaacttttcttcttgggttgaggaaaacgcctttggagtcaggccctggaggggcgagccttgctcacaggagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297387 - DNA, 1062 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaaaagaaaaaacaaaaaaaaaaaaaaaaaaaaaaaaaaaaaaaaaaaaaaaaaaaaagaagaaacaaagtaaaacaacaaaaacacaacaaaaaaaaaaaaaaaaacctttgtcggccctcttggcccaataagattaaagcctggaacaagtttcgtccctgcgcccaaattgggggctcattgggccaattcccctaaagggggggccttttaacagtccgggggccggttttaacacaacgtggaatggaaccttgggtgtaccttaagtgcggttgggaacttctcttc

SEQ ID NO: 297388 - DNA, 843 bp, Homo sapiens
  misc_feature (826)..(826): n is a, c, g, or t
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaagtcgcncggccgcgaatttagta

SEQ ID NO: 297389 - DNA, 1064 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtgaaaaaagagagatgatggagaaagggaaggagggaaggaagacaaaaaggggcgcgacaaaaaagatcccgagggagccaaagaagcgacacagattttggcaaaagcggcccatagggaggcaatataacgcggacggagcccaggtaaaacacaggagaggaacaagacagcgcaatcagggaggcaccaccggcggggaccatggacacccacgaaaatacgcgagggtacaacaagagagaggacgc

SEQ ID NO: 297390 - DNA, 986 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaacacaagagaaaaactctgaggggggccggtaccaatcgcgcctatagaggccgattacaacacgggcggggtagcgggagggaacccgggtcccaatacccgtgagaaccgtgcgcgggggtaagaaagaggcggtgcccaacaggacggagaaggcaacggctgcgacg

SEQ ID NO: 297391 - DNA, 1035 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaacaacaaaaacacaacaaaaaaaaaaaaaaaaacctttgtcggccctcttggcccaataagattaaagcctggaacaagtttcgtccctgcgcccaaattgggggctcattgggccaattcccctaaagggggggccttttaacagtccgggggccggttttaacacaacgtggaatggaaccttgggtgtaccttaagtgcggttgggaacttctcttc

SEQ ID NO: 297392 - DNA, 863 bp, Homo sapiens
  misc_feature (815)..(815): n is a, c, g, or t
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtggngaaaaaaagagcctcccacctcgagggggtggccccgggtccccaatt

SEQ ID NO: 297393 - DNA, 784 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297394 - DNA, 715 bp, Homo sapiens
gcggccgcctactactactactactactgctcgaattcaagcttctaacgatgtacggggacatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaaaagaaaaaacaaaaaaaaaaaaaaaaaaaaaaaaaaaaaaaaaaaaaaaaaaaaagaagaaacaaagtaaaacaacaaaaacacaacaaaaaaaaaaaaaaaaacctttgtcggccctcttggcccaataagattaaagcctggaacaagtttcgtccctgcgcccaaattgggggctcattgggccaattcccctaaagggggggccttttaacagtccgggggccggttttaacacaacgtggaatggaaccttgggtgtaccttaagtgcggttgggaacttctcttc

SEQ ID NO: 297395 - DNA, 732 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataatgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 297396 - DNA, 588 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaaccgtggactagtagccaaccgtggactagtagcaaaccgtggactagtagccaaccgtggactagtagccaaccgtggactagt

SEQ ID NO: 297397 - DNA, 733 bp, Homo sapiens
aagacactcgtccccagagccgcttcctgggactctctagcctcctaccgcttctcagtgatgttccggtttccgccctcctcctcggctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggcttaggcctgtaatcccagcacggggaggtggaggcgggtggatcactgtagagaccagcctgggcaacatggtaagcagcaagcgggtaacctctaggtca

SEQ ID NO: 297398 - DNA, 277 bp, Homo sapiens
  misc_feature (260)..(260): n is a, c, g, or t
gcggccgcctactactactaaattcgcggccgcgtcgacagtgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaagtcgcncggccgcgaatttagta

SEQ ID NO: 297399 - DNA, 1469 bp, Homo sapiens
aaaaaaaaaaaagaaagaaaaaagaaaaagaaaagaacagagctgtgattttcagccaaaatgagcagccctggcccattctgtgtcatcagaggggagaggacggttactgtgggagggggcttcagcttctcagggaggtcctggcggcccccatctagtaaaccagtaaacccatgcctatcctcatgcccacgtcacactcttgtgggtttcaagtcgaacagtaaaaggaatcataagatctgtggggaagctacatgggcactcgtgtttcacaacagggacccttaaaggcgatgtttccagcaaaggatgtgattttttttttttttttttttgagataagttctcactgcgttgcctaggctggagtgcagtggtcattcacagacacacacatagcagactacagactacagccttgaactcctggggctcaagtgatccacccacttctgtatcctgagtccctggaacggcaggtgcacaccaccgcacccggcttggatgtgatcttttgtccacattcttttccaattggttcaaaggtgtaggtgtgccttttgcatacctgggaagggccccattaggctcgactcctcatttttctccattcaccatcagtttgagtctgaattcatagcatggcctggacagatgcagcaaggggccagttccaaggcagaattcagggtgaactcgattcctataggcttgggatgaatggctgctgggacatgaggcttgggtgtgagatgccccgtctgctgctgctcttggttcttagttcagagaaattctgggacccttcctcctcccggcaccacgttttcagtgaatggttctttgaagaggaaccctggtccataggaactgagtgaaagcaaggccaagtatgtccacccatggggacaaacgtcccagcacaaaggggtctcaggcctgcaaggcccaagtggacgctcggacaagggcaggaaggtatttgctgattctccttctccatgtgacgtgtctctcaacccacaccagctaggggagcctcccgcagcttcagttcccctttgacgcccacacagtgttatgcaagcaccgagcccagagtcccgctgggccgtggtgtcctaattgtcttggtgacaaagagcaattttattttaaagcaactgaatcctttccccctgttttgtgtgccagtattttactgtcttcttaattgttttaagcaatgtttactttggatttctggatgttatataaaagccacgaaaaccctggccatgctgtttgtcaggcccacctggctgagtgcaggaagcaagcgcttttcaggagctcactgcaacaccgggcaaacacttcttccgccagggatgcggttaggacaatgccacgtggcgtcacagtatgctgttatttattccaataaagacctcgtgagcatgggcctgtcacaccgtctttgt

SEQ ID NO: 297400 - DNA, 4623 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaa

SEQ ID NO: 297401 - DNA, 4822 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaacccaaactcagtctcattgtctgtttctagagaaacccagtctacaacagagggttcaagagactggacaaagggaattgggtcagtggcccagcaactgcagctaggccggtcggatgtatcctaatgtcagaaggttctggtgtgaactttgagttcagaaaagaacaagactcaggtggtgggggtaccagcggag

SEQ ID NO: 297402 - DNA, 3218 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgatcttgcttatattatcataaaaaggcttttttacccttcgggggggggcccggggccccaatttttcccctttaaggggagac

SEQ ID NO: 297403 - DNA, 3279 bp, Homo sapiens
  misc_feature (3159)..(3159): n is a, c, g, or t
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgagggtgatggcagcaggcgcctgtnatcccagctactcagtaggctgaggcaggagaatggcttgaacccgggaggtggagcttgcagtgggtggagatcgcgccactgcactccagcctgggcgacagagcgagactccgtctg

SEQ ID NO: 297404 - DNA, 4467 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagccggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaa

SEQ ID NO: 297405 - DNA, 4362 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaa

SEQ ID NO: 297406 - DNA, 3128 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccgacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaa

SEQ ID NO: 297407 - DNA, 3081 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccgcctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaa

SEQ ID NO: 297408 - DNA, 3556 bp, Homo sapiens
ctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgtgtattaggaacatgttggacagtggaaaattttctctggatgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactctgaaaaaaaaaaaa

SEQ ID NO: 297409 - DNA, 2631 bp, Homo sapiens
taagtgtatgttctggagggagaacgggtctcattctgggcactgggaggcactttcacccggttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgtgtattaggaacatgttggacagtggaaaattttctctggatgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactctgaaaaaaaaaaaa

SEQ ID NO: 297410 - DNA, 1798 bp, Homo sapiens
ctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcaggtgagtactatcctctccccttccaattttgctgattgaattcaccttccctttggggaaattttgtgatttgggttccttggtgatgtgtgaaccaaggtctctcttagacgtgtcaacttttgcagagttcaagtgtaaggctggatctttatagtcacatccatacaaggcttgagttggaatcctgcctattgtgtgggttttcatcttggcagatgatgaacatggttcctgtttttaaaaactgttcctaaatgatttcttaggtcataatcaatttaacaccagtaaaatgtcttgaattttattttggggtacaagaatcttctttttctctttctttcctgtccttcagttcttttattaaaaaaaaaaaaaaaatcaccatctgacaaaacattcaaaatccctctcttccccactaccacaatccacccaccaccatcctttcctcaaggatgaatcagagaagagtatctgttgagagacccctaaaacctattctgcttccatgaaacacaacagatacactgagaagcaaagtcctttcctctggttacaggaacactgaaagtcattataaccattgatgacagaatgttttgattattactaagcgtgttcagtctggaagatgagaagtcttacttggctgtgtcctaggaactgatgacttaggaacagtattgacaactctgtgttctgctgagggccagtgaattctatacacattaaactttgtagattgaataaatgtttacatataaacatactactatggatatatgtatataaagactgt

SEQ ID NO: 297411 - DNA, 247 bp, Homo sapiens
gagacagagcccagaggaaaagggtcatatagaagaggctaccttgagaagatcagtaatataaccagctcagggtgaccttgcagagaaaggggcaggggaacgtacaccctgacctcattctttcttccaatcttctagttggatttccaatttaaaaaaaacaaaaactggaagccaaaggactcatttattggtgtgggtatctatgggacagatgtataattgtgataataaatgtgagaat

SEQ ID NO: 297412 - DNA, 674 bp, Homo sapiens
ccgggcgtggtggcacgcgcctgtaatcccagctactcaggaggctgaggcaggagaattgcttgaacccaggaggcagaggttgcagtgagctgagatcacgccactgcattccagcctggccgacagagcgagactccgtctcaaaaaaaaaaaaaaaaaaagaacaaaagaaatactttaattacttgttagcctgacagcagatttttgcaataaagcaaaattataattaccatagtgcagatatcttactagacctcttcaagtactacatgaaatttatcatcaacattatcatcatatcattatcagtattaagtttgcattgtgtataggacactatacgaggagtgccagatgatataatgtagtgcttttgccctgaaaggattttccctccagctgtggggataggatacaaaattaatagtgattacggttagtatatcctgagtgccctgatggtttgtgttgataatattgttccagtccttgtttctgtccaaaagaacttcatttctatgtgatttcactgcctgctttatgtcattgactagatgttttgtcatctcagcatttgaaatgctaaactggaaacccagctctcacaatgcaatgctttcttctgactacctccaacaaagaatgtcagagaaggaacaaatgcctga

SEQ ID NO: 297413 - DNA, 3356 bp, Homo sapiens
agcagaggcgggaccagaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataacctattgactgtattctgtgtattattctttattttgggaccttctgtgtaaaagaaaatattacctaaattggttagatacaaagaaatcattaaaattattaatgtatatat

SEQ ID NO: 297414 - DNA, 597 bp, Homo sapiens
agcagaggcgggaccagaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggatgacagtgatgggaggagaatctgatgatctggctacggatcacttcaggtgccattgtt

SEQ ID NO: 297415 - DNA, 3246 bp, Homo sapiens
agcagaggcgggaccagaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataaccta

SEQ ID NO: 297416 - DNA, 3589 bp, Homo sapiens
agcagaggcgggaccagaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataacctattgactgtattctgtgtattattctttattttgggaccttctgtgtaaaagaaaatattacctaaattggttagatacaaagaaatcattaaaattattaatgtatatattgcaaaaaaaaaaaaaaaaaacaaacccaaaaacaaactgtgtgtgcgggcgctcggccccagaaaaacttttctaaacaccactccgtgggggccgcgggccagaggttacggaaccggccacacgggcccaagaaaccgggccagactcgggtgtgtctcccaataaaaaccccggccccgggtctcggaccacccaggggccgggcacgggtccacccgggcaaggggat

SEQ ID NO: 297417 - DNA, 2852 bp, Homo sapiens
aacaactaactacatgtcatcttagaacaggctgcttcatagtttatagtggaacagtttccatattctagaaaattagaaaagcttttgataaaagagaactagaaaatttgtcagtaggctatattaaaagacatccttcttggactcttactgcaataattgctttggcttttgaatatactgcattcagaagctaaatcttccctgtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataaccta

SEQ ID NO: 297418 - DNA, 2279 bp, Homo sapiens
atgtgttctggatattatccctttaacctaaatatatatgtttaaccttggcacatacaggcccacttaacttagtatctgtttcttcttggaaatatcctaattttcaattaaatatattcttgatgtaatttctcttttaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataaccta

SEQ ID NO: 297419 - DNA, 2334 bp, Homo sapiens
agagtttcagaaccaagatcacccactgcacttagcctagtgacagagcgaactctgcctcaatcaatcaatcaatcaataaaaaataaggctgggcgtggtggctcacgcctgttatcccagcactttgggaggctgaggcaggtgtatcacctgaggtcaggagtttgagaccagcctggccaacatggtgaaatcccatctctactaaaaatacaaaaattagccaggcatggtggtgggtgcctgtaatcccagccactggggaggctgaggcaggagaatcacatgaacctgggaggcagagattgcagtgagccaagatggcgccattgcactccagtctgggcgacaagagtgagactccatctcaaaagaaaaaagaaaaatcaaaaaaaaaaaaaaagaatagggagtttatcgttagtatcttatggcagactgcaaatattcatatttaaacttaggttaaagttcatagcaataatgataatatgacggttttttattttgttaactctattattaatatcctccctacccttctttttccctgacagtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataaccta

SEQ ID NO: 297420 - DNA, 1590 bp, Homo sapiens
  misc_feature (21)..(21): n is a, c, g, or t
  misc_feature (30)..(30): n is a, c, g, or t
  misc_feature (39)..(39): n is a, c, g, or t
gtgttgcgggtgatctagagntcccgtcantttctacgnttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataaccta

SEQ ID NO: 297421 - DNA, 1254 bp, Homo sapiens
  misc_feature (21)..(21): n is a, c, g, or t
  misc_feature (30)..(30): n is a, c, g, or t
  misc_feature (39)..(39): n is a, c, g, or t
gtgttgcgggtgatctagagntcccgtcantttctacgntcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacatgatgctattttaatattttcaaataaataatctgaggatgtgtttcatactttagcatcaacgctgagttgtgccttgtagaattgcattgtctatacatgcaaaagactattaagttaggatgaactagattccctaattacagtgaaattctatcttgcaaatgctatagaataacttgcattttaaagtgtatttgcacattttacatatgctatgtggttgcctttgggttttctgtacagattgtttttgttattaaatggaaaaggcctgaattatgctcttatgtgaagtaaattgatataaccta

SEQ ID NO: 297422 - DNA, 187 bp, Homo sapiens
tgctctccaggtgaccctggtgccattgaaatgacatggatggatgtccctggagataaacttttggagccagttgtttccatggtttgaaattttgtttgtttttaagaaaatattttaaaacattatacttcataattttcagttatataagatttgctggaaaatcttagtataaacaggtgta

SEQ ID NO: 297423 - DNA, 288 bp, Homo sapiens
aatttctcttttaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggtaagtcatttttatctatcctttcctatcttttttttttttttttgagacag

SEQ ID NO: 297424 - DNA, 2800 bp, Homo sapiens
agcagaggcgggaccagaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgttcccttgggaaccgcctgggaactccgccatgtcatccacttcgcccaacctccagaaagcgatagatctggctagcaaagcagcgcaagaagacaaggctgggaactacgaagaagcccttcagctctatcagcatgctgtgcagtattttcttcatgtcgttaaatatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggaatgacagtgatggggaaggagaatctgatgatcctgaaaaaaagaaactacagaatcaacttcaaggtgccattgttatagaacgaccaaatgtgaaatggagtgacgttgctggacttgaaggagccaaagaagcactgaaagaggctgtgatactgcctattaaatttcctcatctttttacaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaaactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggggttggtgtagacaatgatggaattttggttctgggagctacaaatataccctgggttctggattctgccattaggcgaagatttgagaaacgaatttatattcccttgccggaaccccatgcccgagcagcaatgtttaaactgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggttcgcggaccttcccgagctgatcctaaccatcttgtagatgatctgctaacaccttgctctccaggtgaccctggtgccattgaaatgacatggatggatgtccctggagataaacttttggagccagttgtttccatgtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcagcctcccgagtagctgggattacaggcgacaccacagcctggtaatttgtatattgatagagacggggttcaccatgttgaccaggctggtcttgatcttctggcttaggtgatccactttggcttgggcctccccaaaagtgcctgggaatgcaggcatgagccactacccccgggctcgggggtggtatgtgaaatagctgaaaccgggtatccgggagggaccaatgctgtaagtggccgacacataattttcaggttaacgggatgtcaaattacgggacgactcagtgggaccagaggtcaaacactgcatgggacgtaactaaacggatgaggccttgacaaggggggaagaccctgcctggggtacggacaactcaaggcacatacaacgaacacggttacggggtgtgtcacaattgctcgccccgacgtggcttaaaaaa

SEQ ID NO: 297425 - DNA, 5677 bp, Homo sapiens
aactgagcggcggcggcggggcgctggggcggagactgcgacccggagccgcccggactgacggagcccactgcggtgcgggcgttggcgcgggcacggaggacccgggcaggcatcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgttgctcagtttgtctaagccattcactcagctaatactaatgtagaaaatatattttaaagtctaattactaatacatagccaaaggaaacccataaacttgataatccataaggaaacaatagtaaaaaaatgttttggggcagtctgcaaaacagcaattttgtttaggaaaagtggactttgttatgcttttctgcatggccaaattataccagaagataattccatagagatgcagcaatcaccttttttaaagatttcattaaatgaagatattcttgttttctgtggtagtctttattattattttttagctattgatacatagcatggcagcaagattacatcagtaatgtaatataatacagcttttttcattgaagctttgtaccttactatactctaggctatttggagtgttcccccacttgcactaaagtacaactatgatgtctctactgcctctcccagtgaaatataaaaatattgcactacattacagatatagtttacaaatgtcattagcagcattactgagctttctataattgtggtctacagagttaaatacttttaaaacatgagtagattcttataaaaccaaagttttgcattatttcaacagctctttcaaatgcatcagtttcagcaacatgcttgggtatcatgaaaacttccatggtttaatcaataaacaccagctacttacaagtagtccaccttccaggttatcaatggtaagttattttttataaagtggttacacactgagcagattgcctcaagtgtaagttatggaacaatactttagctttcagggaatttggtgtgtaaattcttctatagcagtgttcttttaaaataagatcacgtggccgggcgtggtggctcacacctgtaatcccagcactttgggaggccgaggcaggtggatcacgaggtcaggagatcgagaccatcctggctaacatggtgaaaccccgtctctactaaaaatacaaaaaattagccgcgcctgtactcccagctactccggag

SEQ ID NO: 297426 - DNA, 5624 bp, Homo sapiens
aactgagcggcggcggcggggcgctggggcggagactgcgacccggagccgcccggactgacggagcccactgcggtgcgggcgttggcgcgggcacggaggacccgggcaggcatcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgttgctcagtttgtctaagccattcactcagctaatactaatgtagaaaatatattttaaagtctaattactaatacatagccaaaggaaacccataaacttgataatccataaggaaacaatagtaaaaaaatgttttggggcagtctgcaaaacagcaattttgtttaggaaaagtggactttgttatgcttttctgcatggccaaattataccagaagataattccatagagatgcagcaatcaccttttttaaagatttcattaaatgaagatattcttgttttctgtggtagtctttattattattttttagctattgatacatagcatggcagcaagattacatcagtaatgtaatataatacagcttttttcattgaagctttgtaccttactatactctaggctatttggagtgttcccccacttgcactaaagtacaactatgatgtctctactgcctctcccagtgaaatataaaaatattgcactacattacagatatagtttacaaatgtcattagcagcattactgagctttctataattgtggtctacagagttaaatacttttaaaacatgagtagattcttataaaaccaaagttttgcattatttcaacagctctttcaaatgcatcagtttcagcaacatgcttgggtatcatgaaaacttccatggtttaatcaataaacaccagctacttacaagtagtccaccttccaggttatcaatggtaagttattttttataaagtggttacacactgagcagattgcctcaagtgtaagttatggaacaatactttagctttcagggaatttggtgtgtaaattcttctatagcagtgttcttttaaaataagatcacgtggccgggcgtggtggctcacacctgtaatcccagcactttgggaggccgaggcaggtggatcacgaggtcaggagatcgagaccatcctggctaacatggtgaaaccccgtctctactaaaaatacaaaaaattagccgcgcctgtactcccagctactccggag

SEQ ID NO: 297427 - DNA, 4703 bp, Homo sapiens
aactgagcggcggcggcggggcgctggggcggagactgcgacccggagccgcccggactgacggagcccactgcggtgcgggcgttggcgcgggcacggaggacccgggcaggcatcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgtatagctgaatttttttaaagcaatttggaaatatttggctcttaaaaataagacaaagggaaaca

SEQ ID NO: 297428 - DNA, 4970 bp, Homo sapiens
aaattttttacgtttgagtttgttgatgttttattacagctttcattttattctaattttttatcatcttaaaaatgtttggacaagactttccaaggagtgtattttcattttatgtcagaaattatttaaaatgttttatttcacagtttaacttttcccctgcatcatcttaagcttgacagtgtcttaaacacttcaggacaaccaacctgaaacaatagcaagatgtttttctagaataaaatctcttctaccaatggccaatatccatccctcatgaggcctacttgttcttgtcaaaacttgagggtggactaggctgatctttcacatatgccggtgacaagtttttcatggtggtcataaaactcgtttcaagctttgacttttaaagatttggagggtccggttcttcacaaaccccacccttcttcctcctgttttcttcagaagggaacaggcataccacgctcagagaaaacacaagttcaagactttacgagatgatttagagttggatctcttgttattttagcataatgtttatttcctcttacagattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgttgctcagtttgtctaagccattcactcagctaatactaatgtagaaaatatattttaaagtctaattactaatacatagccaaaggaaacccataaacttgataatccataaggaaacaatagtaaaaaaatgttttggggcagtctgcaaaacagcaattttgtttaggaaaagtggactttgttatgcttttctgcatggccaaattataccagaagataattccatagagatgcagcaatcaccttttttaaagatttcattaaatgaagatattcttgttttctgtggtagtctttattattattttttagctattgatacatagcatggcagcaagattacatcagtaatgtaatataatacagcttttttcattgaagctttgtaccttactatactctaggctatttggagtgttcccccacttgcactaaagtacaactatgatgtctctactgcctctcccagtgaaatataaaaatattgcactacattacagatatagtttacaaatgtcattagcagcattactgagctttctataattgtggtctacagagttaaatacttttaaaacatgagtagattcttataaaaccaaagttttgcattatttcaacagctctttcaaatgcatcagtttcagcaacatgcttgggtatcatgaaaacttccatggtttaatcaataaacaccagctacttacaagtagtccaccttccaggttatcaatggtaagttattttttataaagtggttacacactgagcagattgcctcaagtgtaagttatggaacaatactttagctttcagggaatttggtgtgtaaattcttctatagcagtgttcttttaaaataagatcacgtggccgggcgtggtggctcacacctgtaatcccagcactttgggaggccgaggcaggtggatcacgaggtcaggagatcgagaccatcctggctaacatggtgaaaccccgtctctactaaaaatacaaaaaattagccgcgcctgtactcccagctactccggag

SEQ ID NO: 297429 - DNA, 3704 bp, Homo sapiens
ccgttattgatatactacaccgcgaccgcgcctgagtttttttttttgagggtgtgtgtgtgcaaaattgtggtcttacccccgtttttgctacacacgctgggcaatatatggagggtttagcgcccttttttggggcttctcacaggtgttgattggttgaagcagatccttcagcccctgtttatatgggacccggatgttatagcgtggagtacctatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgttgctcagtttgtctaagccattcactcagctaatactaatgtagaaaatatattttaaagtctaattactaatacatagccaaaggaaacccataaacttgataatccataaggaaacaatagtaaaaaaatgttttggggcagtctgcaaaacagcaattttgtttaggaaaagtggactttgttatgcttttctgcatggccaaattataccagaagataattccatagagatgcagcaatcaccttttttaaagatttcattaaatgaagatattcttgttttctgtggtagtctttattattattttttagctattgatacatagcatggcagcaagattacatcagtaatgtaatataatacagcttttttcattgaagctttgtaccttactatactctaggctatttggagtgttcccccacttgcactaaagtacaactatgatgtctctactgcctctcccagtgaaatataaaaatattgcactacattacagatatagtttacaaatgtcattagcagcattactgagctttctataattgtggtctacagagttaaatacttttaaaacatgagtagattcttataaaaccaaagttttgcattatttcaacagctctttcaaatgcatcagtttcagcaacatgcttgggtatcatgaaaacttccatggtttaatcaataaacaccagctacttacaagtagtccaccttccaggttatcaatggtaagttattttttataaagtggttacacactgagcagattgcctcaagtgtaagttatggaacaatactttagctttcagggaatttggtgtgtaaattcttctatagcagtgttcttttaaaataagatcacgtggccgggcgtggtggctcacacctgtaatcccagcactttgggaggccgaggcaggtggatcacgaggtcaggagatcgagaccatcctggctaacatggtgaaaccccgtctctactaaaaatacaaaaaattagccgcgcctgtactcccagctactccggag

SEQ ID NO: 297430 - DNA, 2878 bp, Homo sapiens
agctcggtaccccacaccacctgagtcctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgttgctcagtttgtctaagccattcactcagctaatactaatgtagaaaatatattttaaagtctaattactaatacatagccaaaggaaacccataaacttgataatccataaggaaacaatagtaaaaaaatgttttggggcagtctgcaaaacagcaattttgtttaggaaaagtggactttgttatgcttttctgcatggccaaattataccagaagataattccatagagatgcagcaatcaccttttttaaagatttcattaaatgaagatattcttgttttctgtggtagtctttattattattttttagctattgatacatagcatggcagcaagattacatcagtaatgtaatataatacagcttttttcattgaagctttgtaccttactatactctaggctatttggagtgttcccccacttgcactaaagtacaactatgatgtctctactgcctctcccagtgaaatataaaaatattgcactacattacagatatagtttacaaatgtcattagcagcattactgagctttctataattgtggtctacagagttaaatacttttaaaacatgagtagattcttataaaaccaaagttttgcattatttcaacagctctttcaaatgcatcagtttcagcaacatgcttgggtatcatgaaaacttccatggtttaatcaataaacaccagctacttacaagtagtccaccttccaggttatcaatggtaagttattttttataaagtggttacacactgagcagattgcctcaagtgtaagttatggaacaatactttagctttcagggaatttggtgtgtaaattcttctatagcagtgttcttttaaaataagatcacgtggccgggcgtggtggctcacacctgtaatcccagcactttgggaggccgaggcaggtggatcacgaggtcaggagatcgagaccatcctggctaacatggtgaaaccccgtctctactaaaaatacaaaaaattagccgcgcctgtactcccagctactccggag

SEQ ID NO: 297431 - DNA, 1558 bp, Homo sapiens
aaattttttacgtttgagtttgttgatgttttattacagctttcattttattctaattttttatcatcttaaaaatgtttggacaagactttccaaggagtgtattttcattttatgtcagaaattatttaaaatgttttatttcacagtttaacttttcccctgcatcatcttaagcttgacagtgtcttaaacacttcaggacaaccaacctgaaacaatagcaagatgtttttctagaataaaatctcttctaccaatggccaatatccatccctcatgaggcctacttgttcttgtcaaaacttgagggtggactaggctgatctttcacatatgccggtgacaagtttttcatggtggtcataaaactcgtttcaagctttgacttttaaagatttggagggtccggttcttcacaaaccccacccttcttcctcctgttttcttcagaagggaacaggcataccacgctcagagaaaacacaagttcaagactttacgagatgatttagagttggatctcttgttattttagcataatgtttatttcctcttacagattccatttgcaaaaaacatttatggactcatagctccgaactttggagttggttttgcaattggtaagtcacacgaaccttgtgcctacatttaaaaccgcttttccactaggaagggttcttcttcctctggtagactgtagttcctcaacctaaatttccagaatcttagaaggaggctgcaggcagcttagctaaattacagcctgtcgattctccgtgtaaatacacctgcttctatgcactagtcatttatttcctgaaaaccagtattttttaaaagctgatatttacagaaggaaactgatgctccactgctggggctgggcaaacaaaggaatcccttgcacagagctcatttttgtggactcctccctatgagcaggtcttctcatgaggctgggggcaaaggcttcacatatgtattttgaagaggttttagtacagacaaagcagactaatgtgttgatgaccgcctgtgctgcaggaattcccatgggcaaggagatgggcttttgtaatgttaagaatgataatatgttaggaaaaatctgtcactattttgagtgaatggtatacttttgtctcttatttataatataccaattgatcatgataaaaataagtgctcagtccacccctgtagaagcaggaacgcaacctttgagtggtacagtggcacagcatggctttcactgaggacagatggtagaaggctgctgaggctggggtagaactcagtatggtactctaggtccttctcaggtgaccgtttgcctgtcctctgccttgcctccccttgtcctccactgtctggttggcccatctttttagggagggtgctagtcctctggcggctccccttgccattctgcaggtctggcagagttgcaggttgctaactgtacggcccctggcctgcatccttttggtgctttcctgctttgctgttttctggttcacttgtccctcaccactcagcacacctgcatgcc

SEQ ID NO: 297432 - DNA, 5623 bp, Homo sapiens
aactgagcggcggcggcggggcgctggggcggagactgcgacccggagccgcccggactgacggagcccactgcggtgcgggcgttggcgcgggcacggaggacccgggcaggcatcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttaattttattaaatatcatacaatatattttgatgaaataggtattgtgtaaatctataaatatttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgactgtggatatttaattaaaaactatttttctgtgcttgtaggcatcaggtaaaagccaccccaggttagcttgaccatacttttttggctttccacaatttattttaaattgagatatgtaactagccacattcaatgtggaaaaaacccaggaagttatccttccatctataaacattgttgtcctgatggttgtcaacaaataaccatatctgatgaaaacagctgtaatatccacccatttgacttaatcccgggggagtttgtaaaaccgttgaaatctgatacattttgaatggtgtgcccatgggtatcttcctgcggtgaaagtccacatctttaatcagatcctaaaagcggatctatggcccaaaaggaattaggggaacctctccttcttttggtaagaaaagcaattatgtcaatttagaagacagtatttttaaaagtaggtatttaaaatttattcacttttaggggacttaacattttattatttatcttatttttaagagccaaatatttccaaattgctttaaaaaaaattcagctatacatttagaacttgatagtacccctcaaaatttttaggttgtgttttctcctcccagcatcacaaaatagccacttatttcaagtacttctgatattgaatataaggcttgatatgaagaagtatagcctattatgattgctaataatgctaaaatgttgctcagtttgtctaagccattcactcagctaatactaatgtagaaaatatattttaaagtctaattactaatacatagccaaaggaaacccataaacttgataatccataaggaaacaatagtaaaaaaatgttttggggcagtctgcaaaacagcaattttgtttaggaaaagtggactttgttatgcttttctgcatggccaaattataccagaagataattccatagagatgcagcaatcaccttttttaaagatttcattaaatgaagatattcttgttttctgtggtagtctttattattattttttagctattgatacatagcatggcagcaagattacatcagtaatgtaatataatacagcttttttcattgaagctttgtaccttactatactctaggctatttggagtgttcccccacttgcactaaagtacaactatgatgtctctactgcctctcccagtgaaatataaaaatattgcactacattacagatatagtttacaaatttttaaaacatgagtagattcttataaaaccaaagttttgcattatttcaacagctctttcaaatgcatcagtttcagcaacatgcttgggtatcatgaaaacttccatggtttaatcaataaacaccagctacttacaagtagtccaccttccaggttatcaatggtaagttattttttataaagtggttacacactgagcagattgcctcaagtgtaagttatggaacaatactttagctttcagggaatttggtgtgtaaattcttctatagcagtgttcttttaaaataagatcacgtggccgggcgtggtggctcacacctgtaatcccagcactttgggaggccgaggcaggtggatcacgaggtcaggagatcgagaccatcctggctaacatggtgaaaccccgtctctactaaaaatacaaaaaattagccgcgcctgtactcccagctactccggag

SEQ ID NO: 297433 - DNA, 659 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgttctgcatccccctccctgagccaaccccaggccctttctgcacccacccgagaggaaac

SEQ ID NO: 297434 - DNA, 767 bp, Homo sapiens
ctgtttaaggcatatgcctgtaggaggtcaaccttgattgtttagacacaagagctcctgagacattaaaccctggagtagatcatgggagacttgagaaccacgtataagtgagtataaggttcccctttcctcattctccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtgggtaagagtaacatcactttgcttggcatggtggcctgcacctgtagtcccagatacttgggaggctgaggtgggagaatcgctggagcctgggagtttgatactagcatgggcaacattgtgaaacctcatctctaaaaaaaaatcctaagaataaagactaggccggtcccggaggttcacgcctgtaatcccagcactttggaaggctgaggcaggcagatcacaaggtcaggaaatcaagaccagcctggctaacatggtgaaacctctgtctctactaaaaatacaaaattagctgtgtgtggtggtgggcacccgttatcctagttactcgggcggctgaggcaggacaattgcttacccagaggccgaggttgctgagtgagccagcactgcaccactgcattccagcttagatgaccaagtgagactccatcta

SEQ ID NO: 297435 - DNA, 690 bp, Homo sapiens
ttttttttttagtagagacggggttttgccatgttggccaggctggtcttgaatgcctgacctcgagtgatttgcccaccttggcctcccaaaatgttgggattacaggcatgagcctctgtgcccagtcagaatgctgttttagaattcagccctggtttgtgtgcctttggaaatgctacataagcttcatgagtgttactactatgggcagatagtcacatttttcagggtgtaagtttccttgaaaaatgaaactgttaccctttacacaacaggcagctcagcccatatctgcttttctgggtctaggtgatacaggactactacggcatttcatggaagtgttgtgtgtgtgtagttttttcgagtgtgcaggagcatatgggaatttcaagctaggatggaatgacttctgggcataagaatgtgggcagctctggcttctcatgccttcttacttttccactagggttttttcccagggaaccaatctgtccttttgaagaaaagacaaagataggaacgatggtagaggaccaccggtcaaattcttaccaggtaaacagaaaatgtaccgttgtacaaaatgacatacttacatccaataggtagacacatttccttctagacagactcatctccagagttttcttagagcaaatgaagccttactcaaggactgaatcc

SEQ ID NO: 297436 - DNA, 6317 bp, Homo sapiens
cagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297437 - DNA, 6610 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297438 - DNA, 6861 bp, Homo sapiens
ttttttttttagtagagacggggttttgccatgttggccaggctggtcttgaatgcctgacctcgagtgatttgcccaccttggcctcccaaaatgttgggattacaggcatgagcctctgtgcccagtcagaatgctgttttagaattcagccctggtttgtgtgcctttggaaatgctacataagcttcatgagtgttactactatgggcagatagtcacatttttcagggtgtaagtttccttgaaaaatgaaactgttaccctttacacaacaggcagctcagcccatatctgcttttctgggtctaggtgatacaggactactacggcatttcatggaagtgttgtgtgtgtgtagttttttcgagtgtgcaggagcatatgggaatttcaagctaggatggaatgacttctgggcataagaatgtgggcagctctggcttctcatgccttcttacttttccactagggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297439 - DNA, 6691 bp, Homo sapiens
gaaacccaaaagtcctcagatcacatatatgattacatccataagccaaaccgtgcaagaaatgtacaagataatgttggaacacatgccctgtgtgaaaacaatcagtgactgttagggtcttgtcaaaaggaaaggagccatcttgaagacagtccactggccagtggtggaacaacttaaccataacataatagtttttggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297440 - DNA, 6135 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297441 - DNA, 5768 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctgtagtcccagctactcaggagggtgaggcaggagaatcgcttgaaccctggagg

SEQ ID NO: 297442 - DNA, 3585 bp, Homo sapiens
gtgaaaaatgctgctatgaacatgcgtatacaaatatctctttgagactctgctttcaattcttttgggtacatccccaaaagtggaagtgctgaataattctatttttaattttttaagggatcacaatactcttttctgtagcagctacatcattttatattcccacccacaatgcacaggggctccaatttcttcatatcccttaccagtacttattgtctttgtttgtttatttattggaggacaaggtctcattctcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297443 - DNA, 4143 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaacttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggatttttttttttttttttttttttttttgagatggagttttgctcttgttgcccaggctggagtgcaatggtatgatcttggctcaccgcaacctccacctcctgaaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297444 - DNA, 1865 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaataca

SEQ ID NO: 297445 - DNA, 2307 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttg

SEQ ID NO: 297446 - DNA, 1789 bp, Homo sapiens
  misc_feature (4)..(4): n is a, c, g, or t
  misc_feature (40)..(40): n is a, c, g, or t
  misc_feature (44)..(44): n is a, c, g, or t
gcgnccgcgtggtatctcccgagggctgcttggaccctgntggnctgagtgctccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttaggactaatctgatgatctttgcactgccaataattaaagatggcaaccaatgggctaaatggtcgagc

SEQ ID NO: 297447 - DNA, 1184 bp, Homo sapiens
ttttttttttagtagagacggggttttgccatgttggccaggctggtcttgaatgcctgacctcgagtgatttgcccaccttggcctcccaaaatgttgggattacaggcatgagcctctgtgcccagtcagaatgctgttttagaattcagccctggtttgtgtgcctttggaaatgctacataagcttcatgagtgttactactatgggcagatagtcacatttttcagggtgtaagtttccttgaaaaatgaaactgttaccctttacacaacaggcagctcagcccatatctgcttttctgggtctaggtgatacaggactactacggcatttcatggaagtgttgtgtgtgtgtagttttttcgagtgtgcaggagcatatgggaatttcaagctaggatggaatgacttctgggcataagaatgtgggcagctctggcttctcatgccttcttacttttccactagggttttttcccagggaaccaatctgtccttttgaagaaaagacaaagataggaacgatggtagaggaccaccggtcaaattcttaccagtgaatattggtggaagtgttcattggctcaaaccagcatgtgtttgatgacttaggattcagtgacgtttgatgatgtggctgtggagttcaccccagaggagtgggctttactggacacaactcagaaatacctctacagagatgtgatgctggagaactacatgaacctggcctctgtgggtaagagtaacatcactttgcttggcatggtggcctgcacctgtagtcccagatacttgggaggctgaggtgggagaatcgctggagcctgggagtttgatactagcatgggcaacattgtgaaacctcatctctaaaaaaaaatcctaagaataaagactaggccggtcccggaggttcacgcctgtaatcccagcactttggaaggctgaggcaggcagatcacaaggtcaggaaatcaagaccagcctggctaacatggtgaaacctctgtctctactaaaaatacaaaattagctgtgtgtggtggtgggcacccgttatcctagttactcgggcggctgaggcaggacaattgcttacccagaggccgaggttgctgagtgagccagcactgcaccactgcattccagcttagatgaccaagtgagactccatcta

SEQ ID NO: 297448 - DNA, 577 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggtttgtgctggtcccccgacccgctgcttttttgtaatagttttgtctttgccttttgctgtccacctaagattgatgttaaagagaattagggggcattgcacggattttctgctttaatttttattgtttctttaatcacaggtataattttttttttcttttaaagatggaaaggtgagcttcttaaagtggacagaatacctgtttggtagaagggcagcaggaccagctgtatttgataggtgcactgtgtcataaatttgcagcaggttataacagatgtaagctctgaagtgaacttggcat

SEQ ID NO: 297449 - DNA, 997 bp, Homo sapiens
tatacacgatacccaccagacacctctggctgtattgaaaatacctttgtaatatgtgaaatgtttacacatagaagccagagaaagaggtcatttcatttttaatgatttcctctagctgctgtctggatggcaaagctgatatccaaggttgctaatcaagggatctcacataaatacgttttaggcccaaagtgcacttgtagtgaatatacctagaattacatctgtaggctctaaaaacaagtagaaatcctcgctaacctcatccttaaagattcaaaggctttaccaactcaggtgtcccttaaaaactgggaaatctaattttaaaaatctcacaacattacatccagttcacagagtaaaacaagctgcctgtgaacagctctgaaactatttttccaaaataaaaacccagtggggcgtagggaccaaagtggtgatgtctgtaaagatctaagggtacattttatttgccaggaaagaactcgtgtcactgaatgggctgcacttgtgtatggagaatagctctcccagtgtgcatcagcttcaggacgggggccctgctgaggcgtatagatccttcagaaagtggagggcctgttctcttaacagccagccgttcccttttccccttttttaaactgtcatttttatggcaacattatcattttaactacacaaaagagcttggattgcaaatggactcctggtatacattcttctcagtagtccagatggagccgagggcctgtgacacaggaggcagtggaaggaaagcctcctggtctcgtccagccccgagagcgcgtgcagggggctccaggcacacacaggcgtctgggggtcgcaggcagaggcaccctggtcttcagaagcctctcgattcactgccacccacacagcaggtggcctctccgattccagtcccatcattagggaaagtgtctggaaacatttttgttgttaaaggaaaataaaattattcccaact

SEQ ID NO: 297450 - DNA, 554 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggacttgctctcttccttccagttctagctccgaaacaccctggattacagtctttgaagaagtaggagagccggtggccgaagtgcccactcatgacctggccttgctagtggaggtggcaaccagagaagctggagagcgcctcctgatccacagggaacttcagtaaatccttttgcctccccccggtcgtcagattgcgttcatactgtggtagcaggccccgtctgaggcccatcctggtgttgagaggctggatgctagcagggagctccaggagacgttc

SEQ ID NO: 297451 - DNA, 533 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagttctagctccgaaacaccctggattacagtctttgaagaagtaggagagccggtggccgaagtgcccactcatgacctggccttgctagtggaggtggcaaccagagaagctggagagcgcctcctgatccacagggaacttcagtaaatccttttgcctccccccggtcgtcagattgcgttcatactgtggtagcaggccccgtctgaggcccatcctggtgttgagaggctggatgctagcagggagctccaggagacgttc

SEQ ID NO: 297452 - DNA, 6764 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctt

SEQ ID NO: 297453 - DNA, 6803 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggactctggagatgccacatggaaagaaacattctggttgatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctt

SEQ ID NO: 297454 - DNA, 6387 bp, Homo sapiens
cattgagatatttatgaatgcttgtgtttgtttttttttaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctt

SEQ ID NO: 297455 - DNA, 8402 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297456 - DNA, 7305 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttagaaaaagaaaaaaaaaaaaaaaaaaaaaaaaaaagaaaaaaaaaaaaaaaagaagaaaaaaataaaagaaaggaaaaaaagaaggagagaaaaaaagaaagaaaaagaagaagagaaaagacaaagagaaaggaagaagaaagagaaggaaagagaagagagagagggaaggagaagagcaagggggggggggggagaaaacaagacacacaacgagcagaggaagcacagacaagcagaacaccaccacagtagtcaaaagacgaacacacaaaaaaagaagcaaaaacaaaaaacaaaggaaggaagcaaaaacaaaaacaataggaaggaaaaaacaagcaggaagataaaagaacaaaaacaaagggagagaaaaaaacagcaacaaaataaaaaccaaagaaaaaa

SEQ ID NO: 297457 - DNA, 8468 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297458 - DNA, 6959 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctt

SEQ ID NO: 297459 - DNA, 7188 bp, Homo sapiens
taccccccacccctcaggcagcggcaggatgcagggtattcaacttgcctccatggtctgtaagccccgcacctatgtgtgggggtgacagatatacagggctcatgcttgtgcatcagaacaaatcccaagaagctgttcttctgttccactttaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297460 - DNA, 6246 bp, Homo sapiens
agatcgagctcggtacgaattcgctagttgtgcagtgcaggtcctcgtgagaagcgtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297461 - DNA, 5710 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaatt

SEQ ID NO: 297462 - DNA, 5890 bp, Homo sapiens
tcgagctccgtacccccaaaaaaaaaaaaaaaagaaaaagtccaaagacaatagagatgactagaagggatggatgggcctttgactttcagaaatgcctaaatgtatgcattttatttaaaatattgcagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcattttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297463 - DNA, 2467 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggtagtccagatggagccgagggcctgtgacacaggaggcagtggaaggaaagcctcctggtctcgtccagccccgagagcgcgtgcagggggctccaggcacacacaggcgtctgggggtcgcaggcagaggcaccctggtcttcagaagcctctcgattcactgccacccacacagcaggtggcctctccgattccagtcccatcattagggaaagtgtctggaaacatttttgttgttaaaggaaaataaaattattcccaact

SEQ ID NO: 297464 - DNA, 4838 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaatt

SEQ ID NO: 297465 - DNA, 3774 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatactctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297466 - DNA, 2440 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggctcgggaaccttgcaaaggccctggggcaggtgagagagaagctggtgcttttggggatttgagagaaggccagggtgcctgagaggtgggaaggtgcaactagtcacg

SEQ ID NO: 297467 - DNA, 1225 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtagtcagatgcctccgcagccacccgggagccagtcagaatccagttcccatcccgccttgagccagtcaccaatgccacaggaaagaggttttatggcaggcacacaaagaaaccctcagatgctcagtatggacctcaacagacaggaccgtccatctacccatcttggcccgagtcta

SEQ ID NO: 297468 - DNA, 2121 bp, Homo sapiens
ttaagaataaatgtacattaaatctaccatcacttcgtagttaccacatcatgaaaaagaaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatctttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaat

SEQ ID NO: 297469 - DNA, 315 bp, Homo sapiens
atgtaatgagaaatcacccaaaagaaggtagtttgaaatttgaggccagacgcggtggctcacgcctgtaatcccagctctttgggaggccaaggtgggcggatcacttgaggtcgggagttcaagaccagcctgaccaacatggagaaaccctatctctactaaaaatacaaaattagccaggtgtggtggtgcctgcctgtaatcccagctactcggaatgctgaggcaggagaatcgcttgaacccaggaggcagaggttgtggtgagccgagatcacgccattgcacttcagcctgggcaacaagagcgaa

SEQ ID NO: 297470 - DNA, 783 bp, Homo sapiens
ccactttaggccaccatacattaggtcgcctgcttatcccagccagtctggggctggcggacgccccatgttttcttcccagcaccccaactatggcaactctcaggctcccatggtgcaccagcctgaccagtacgggtaggtagcaacacaccccgacttgctgcgggacctgggcgttttctctgaaactgttaacgatcgtgccgtctggccgcgaaaggaacacccaaaccaagaaagcgaaacacctaacagaaaatccatctccaagggggttgtccttctgtccatttttgttggtgtgtttgtttcgttttcctttcgtattaacagtactgtggccgttcggtggaaacccgcatgcgtcctcaggccctgtctgtgcatggctttcggcatggctgctttccttcatgcctgagagggaaatagaaactttgatctgtgtcgaagacatgatgtcaccacctctggcgtcatttcccccattgttgtcattgttttgtctaggaacctgtgttgtgcagcgctgttctcatgactatattatcactcctgctgctacagtgagcggctgccatacccacccccaaattaagagcacagcatctcatttgacaagagactcactgcagttgagctgacaggctattcataggacttaggaggagtttcattatatcaccaccaagcaaatgtctgtgccaaaaacttctattattttttctccagcgagtatcagaatattgaagtcaccaggaaaatacaacaaaataatcc

SEQ ID NO: 297471 - DNA, 1071 bp, Homo sapiens
  misc_feature (1067)..(1067): n is a, c, g, or t
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagtaagacattattgtgctgatttggaaatgtaatgagttaaagacttttagaaagagctgttgtttttgtttgttctactttatattatgacatgattgagaagtttctagacttcaggtttattttgtggtcaatttttcaaggtttaccttttaggagctctgtagtcctggataagtctatttcatgtgtatatatctctgttgcagagtgtagacatcagttggaaggttttatgcggctggtcgattttgtgtgcaggtggttattgctgttgtacagttgagctttctttaggctgttgctttttggcagcgatacagaacagaggtgtccttagaggagtcaaaacttaaaagaaatttgcactttgcaaaggatacaaatgatgagataaaatacctgatagtaatttgaatttcttctaggactttctatttatgtaatgagaaatcacccaaaagaaggtagtttgaaatttgagcccctgccccccgtcacttctattctctttctacttagtcccatgactaaaangcgg

SEQ ID NO: 297472 - DNA, 2266 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggtaagtggcggcgctgcagtcactggcccaggaaagcccaggcgcctggcctgggaggttccgggaaggtggtttcacagtcaggccaacagggaacttgggacttttgagaggtggggggttcctgtgtcgttttgtttatttaattggacgcccactggcagtgttaagggatgagagaattaaatctgggatatggccatttctggttgacacttggaagg

SEQ ID NO: 297473 - DNA, 910 bp, Homo sapiens
ggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagtaagacattattgtgctgatttggaaatgtaatgagttaaagacttttagaaagagctgttgtttttgtttgttctactttatattatgacatgattgagaagtttctagacttcaggtttattttgtggtcaatttttcaaggtttaccttttaggagctctgtagtcctggataagtctatttcatgtgtatatatctctgttgcagagtgtagacatcagttggaaggttttatgcggctggtcgattttgtgtgcaggtggttattgctgttgtacagttgagctttctttaggctgttgctttttggcagcgtgaagaattgcactttgcaaggatacagatagactttctatttatgttatgagagatcacccc

SEQ ID NO: 297474 - DNA, 470 bp, Homo sapiens
gccaccgcacccagctgaggtttgtgttttgaagcgctatttcacagaagaaagtctgtctagcctttcttagacctatgtgaccatacctgtaatttcctcaatgatttaattctaagagtcttttttcaaacagactttattttttagagcagttttaggctgacagcaaaactgagcagcagattgtagggatctctcataccctccctccccacaagcaagcacaacctcccccattctcacagccctggcagaggggtccggttgttgacatccatgcgcctggtaggcacatcgcccagagcccgtagtatgctgagcactccctccgccctctcggggggcatatgccctgggtggggacacatgcataatgcacatgtttaaagacatttttatgagtttgaaaattacttttttttttttttttgagacggagtctcaaacaacaacaacaacaacaacaa

SEQ ID NO: 297475 - DNA, 506 bp, Homo sapiens
tgcttttaaaagtccttttaatacagcatgaagaggctatatttctataggcgagccgtatacagattctccaggaataaggcacacaacggaatgccatcccaagggctgcacttcggagacgtcggagccttctccacgcaccttccgagctgggcccacgggttctgttttgtctttttagctggactcacacgtatggacagacacagacacggacggggtcaccgcatgggggcggaggaggtcggacggcaagaatggtgtgattttcgtggtgcctgccctgccatggccgggggcagcaggcacacatgacttgagttggcattcctgacctagatgatccctaaagatccttccaatgcaaatagttccatgagtagacagcacacaggcttgagaagtggacagagtccaagtcctggccactgcttctgcacacctctgggcatgtaacagaggctagtttttgccaggcttgggccacttgggtgctgggcttt

SEQ ID NO: 297476 - DNA, 490 bp, Homo sapiens
tgcttttaaaagtccttttaatacagcatgaagaggctatatttctataggcgagccgtatacagattctccaggaataaggcacacaacggaatgccatcccaagggctgcacttcggagacgtcggagccttctccacgcaccttccgagctgggcccacgggttctgttttgtctttttagctggactcacacgtatggacagacacagacacggacggggtcaccgcatgggggcggaggaggtcggacggcaaggttggcaacagagaaggataagcccgctgccacagcccccaggggaccgcttggccatctcgctgaaggctggaacacccccatttcagggttagtcgttggactgagctacaatgtagtgaggttggattaaatattcgtttagagtagattcaagtctattagatgctggagggctggtgtaagggctccggttgacatttccaagttcaaggagcatggcctggagga

SEQ ID NO: 297477 - DNA, 2242 bp, Homo sapiens
ggctccgagggggcggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaagtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaaaaaaaaaat

SEQ ID NO: 297478 - DNA, 2190 bp, Homo sapiens
ggctccgagggggcggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaagtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgttta

SEQ ID NO: 297479 - DNA, 2389 bp, Homo sapiens
  misc_feature (2378)..(2378): n is a, c, g, or t
ggctccgagggggcggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaagtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttagactggatgtcattgtgataatgattatccagaaaaaaaaaagggggggctaagttcccgagggccagttagcgtccgttgaaagggctaagggggaaaaaaaaccgggggtaacgggaacgtctggtctgggcctttgggttggacccacaaagcggaaaattgaagtcggtggtgtatataatagnagtactataaa

SEQ ID NO: 297480 - DNA, 2192 bp, Homo sapiens
ggctccgagggggcggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaagtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaaaaaaaaaat

SEQ ID NO: 297481 - DNA, 2209 bp, Homo sapiens
ggctccgagggggcggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaaaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaaaaaaaaaat

SEQ ID NO: 297482 - DNA, 2141 bp, Homo sapiens
ggctccgagggggcggggcggaagaaggcggggagggagggggcggcaccgccggtcggctccagtcgcctccggaggaaggaagaagaggacgccgggcgcgcagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaaaaaaaaaat

SEQ ID NO: 297483 - DNA, 2188 bp, Homo sapiens
ggctccgagggggcggggcggaagaaggcggggagggagggggcggcaccgccggtcggctccagtcgcctccggaggaaggaagaagaggacgccgggcgcgcagctcggtgctgattatcacaactgtttggtgacctacttcactgacctaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaaaaaaaaaat

SEQ ID NO: 297484 - DNA, 1824 bp, Homo sapiens
  misc_feature (3)..(3): n is a, c, g, or t
  misc_feature (8)..(9): n is a, c, g, or t
ggncacgnncctcgtgccgaattcggcagagctgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaatgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaaaaaaaaaat

SEQ ID NO: 297485 - DNA, 1677 bp, Homo sapiens
gcgtagagagggacaaaattaagcttaagtagagcctgggtgtttaattggcagagggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297486 - DNA, 1830 bp, Homo sapiens
aaaataacggactagagtacgaggactccgatgttataatgcaggcacgaggcagaggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297487 - DNA, 1855 bp, Homo sapiens
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297488 - DNA, 1633 bp, Homo sapiens
ctgggattgtgccatcagctttgcaagcaagcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297489 - DNA, 1288 bp, Homo sapiens
gcgtagagagggacaaaattaagcttaagtagagcctgggtgtttaattggcagagggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccattccaagtctccacccctttctagaccaataaagagacgaatacaattttctaactcagcaa

SEQ ID NO: 297490 - DNA, 1577 bp, Homo sapiens
gcgtagagagggacaaaattaagcttaagtagagcctgggtgtttaattggcagagggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297491 - DNA, 1663 bp, Homo sapiens
aaaataacggactagagtacgaggactccgatgttataatgcaggcacgaggcagaggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297492 - DNA, 1859 bp, Homo sapiens
  misc_feature (324)..(324): n is a, c, g, or t
cccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcagagggggggagnggggaacaaaaaaagaaaaagaaatcccctgcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297493 - DNA, 1466 bp, Homo sapiens
tggaagctcactccggctctgtcgctgcagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297494 - DNA, 1436 bp, Homo sapiens
gcgtagagagggacaaaattaagcttaagtagagcctgggtgtttaattggcagagggagaggctgtgtcaaaggcgccatgagcaagatcagcgaggccgtgaagcgcgcccgcgccgccttcagctcgggcagatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaa

SEQ ID NO: 297495 - DNA, 1049 bp, Homo sapiens
ccgttccgcgctctggcggctcctcccgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaggactgagcccagcaccacccctgggcagcagcatcctcctctctggccttgccccaggccctgcagcggtggttgtcacaccctgacttcagggaaggtgaaacagggcttgtccctccaactgcaggaaaacccttaataaaatcttctgatgagttc

SEQ ID NO: 297496 - DNA, 1642 bp, Homo sapiens
agagtgaagcaatctttaattttgaaaacagggaaaacaaatatttagaaagtaaaaccgatttccatcctttacatgccattatacatcctatacaaaactctggaaatctgcctattgaggtaattacggagcactacctaatgtgtttcaagggaaagctcccctgtttgggctatgcaggatttacagggagtttaaatcattaaataaccatagttgacccttgcttggttaagagagtaagcaattattgcaaagtcctcttccctgccttccacaaacagcacaaaaacggttctgaagggatttacacaatacatcaacatctgtgctgtacctagagttgttaaaataattgtgatgacaggtgtctaggtaccactttcttaatggttttcaatatccattgatttattgttttgtggctttctcttcccctttacagctttggctttaagaaagagctggggaacagattttgcaccagaggctgattctttattccaatgctgaaaagaactaataaaaataatcacttggcttttaagcagaaagcttccatttacagtatttcacccttaccccgccccgttccaagccccttgttatctaacataatggttagaatacatttccgtctctccccttaataatttcatgcattaacatcctcttcacacactatacacacacgcacgcgcgcacacacacgcgcgcgcacacacacagcaaaaggaaaaaagaggcagcagaaatctcagctgtacttctagcccttttaaaaagtttgctctgtaaattggaatgaggtcagatttggagcttctcattgcacgcggagattattattgcatcgggttccaagccaatgggaagcccgggggaggggtttggcatgaggaagcgttggttacagcagctgattggctgcagccaagactgtgaaaggataaagaggcgcgaggcggaattggggtcggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaaaaaaaaaacatgtcggccggggggaaatcaagtggcttatcatgtatatcgtgtacttaaaatgtattcacaaactactgttgtatttgtataaaatatagacaaagatcataaaaaaaaaaagaccgaaaataaaaaagtcaaaaactgcgaaaaccctggcgatacccaaactaaatcgcattgaaacaaaattccccctctgacagctggccgcactccaaggcccttacccgttgggcgtaccaacaagtgggattgggtttggc

SEQ ID NO: 297497 - DNA, 436 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcag

SEQ ID NO: 297498 - DNA, 522 bp, Homo sapiens
ctgtgtgtttaaacctgaacacatatgctatcatcatgccataagactaaaacaattatatttagcgacaagtagaaaggattaaatagtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297499 - DNA, 1349 bp, Homo sapiens
agagtgaagcaatctttaattttgaaaacagggaaaacaaatatttagaaagtaaaaccgatttccatcctttacatgccattatacatcctatacaaaactctggaaatctgcctattgaggtaattacggagcactacctaatgtgtttcaagggaaagctcccctgtttgggctatgcaggatttacagggagtttaaatcattaaataaccatagttgacccttgcttggttaagagagtaagcaattattgcaaagtcctcttccctgccttccacaaacagcacaaaaacggttctgaagggatttacacaatacatcaacatctgtgctgtacctagagttgttaaaataattgtgatgacaggtgtctaggtaccactttcttaatggttttcaatatccattgatttattgttttgtggctttctcttcccctttacagctttggctttaagaaagagctggggaacagattttgcaccagaggctgattctttattccaatgctgaaaagaactaataaaaataatcacttggcttttaagcagaaagcttccatttacagtatttcacccttaccccgccccgttccaagccccttgttatctaacataatggttagaatacatttccgtctctccccttaataatttcatgcattaacatcctcttcacacactatacacacacgcacgcgcgcacacacacgcgcgcgcacacacacagcaaaaggaaaaaagaggcagcagaaatctcagctgtacttctagcccttttaaaaagtttgctctgtaaattggaatgaggtcagatttggagcttctcattgcacgcggagattattattgcatcgggttccaagccaatgggaagcccgggggaggggtttggcatgaggaagcgttggttacagcagctgattggctgcagccaagactgtgaaaggataaagaggcgcgaggcggaattggggtcggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcag

SEQ ID NO: 297500 - DNA, 642 bp, Homo sapiens
tgtacagacacctttgacatcagcaccagaacaaccgttcatcttttcagcaacctttctcaagttgataccacgagttagattcatttttctggagtggattcttaaaatttcagctctagctgcgacacttggaggtggaaattcaatcttcctatctattctaccgggtctcaaaagtgctggatctagaatatctagtctattcgtggccattatgattttgatatttttagctcgtgccgaattcggcacgagttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297501 - DNA, 428 bp, Homo sapiens
aacaacggcagaaaagaaagtcttgaaagggttatttccaaagagtttgtctcctccgacccgcgctccttggacttttggaaagacaggatttccccacaccagttgagaggctcagcttggctgaggcagctttcccacccctggctgcgtgttcggtccctggtctgtaaacctgtgcccagctgccccagaccctggagccccgggttccgcaggccgggctacatggccttcatgccgttgttcttcgacgaagtacatttaagtctgtattataataagcaaaaagattgtgtgtatgtatgtttaatataacatgacaggcactaggacgtctgcctttttaaggcagttccgttaagggtttttgtttttaaacttttttcaatttttaaacacaacagctataaacctgaacacatgcc

SEQ ID NO: 297502 - DNA, 4934 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297503 - DNA, 5004 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaaaaaaaacttttgtcgttattatgcccaatgcctaagattggaaaggccctacagtatctggacactac

SEQ ID NO: 297504 - DNA, 5847 bp, Homo sapiens
agagtgaagcaatctttaattttgaaaacagggaaaacaaatatttagaaagtaaaaccgatttccatcctttacatgccattatacatcctatacaaaactctggaaatctgcctattgaggtaattacggagcactacctaatgtgtttcaagggaaagctcccctgtttgggctatgcaggatttacagggagtttaaatcattaaataaccatagttgacccttgcttggttaagagagtaagcaattattgcaaagtcctcttccctgccttccacaaacagcacaaaaacggttctgaagggatttacacaatacatcaacatctgtgctgtacctagagttgttaaaataattgtgatgacaggtgtctaggtaccactttcttaatggttttcaatatccattgatttattgttttgtggctttctcttcccctttacagctttggctttaagaaagagctggggaacagattttgcaccagaggctgattctttattccaatgctgaaaagaactaataaaaataatcacttggcttttaagcagaaagcttccatttacagtatttcacccttaccccgccccgttccaagccccttgttatctaacataatggttagaatacatttccgtctctccccttaataatttcatgcattaacatcctcttcacacactatacacacacgcacgcgcgcacacacacgcgcgcgcacacacacagcaaaaggaaaaaagaggcagcagaaatctcagctgtacttctagcccttttaaaaagtttgctctgtaaattggaatgaggtcagatttggagcttctcattgcacgcggagattattattgcatcgggttccaagccaatgggaagcccgggggaggggtttggcatgaggaagcgttggttacagcagctgattggctgcagccaagactgtgaaaggataaagaggcgcgaggcggaattggggtcggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297505 - DNA, 5045 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctgacagagcgagattctatcctaaaaaaaaaaaaaaaaaaaaaaaaaaaaaagcggccgctcgaattcgcggccgcgtcgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297506 - DNA, 4881 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297507 - DNA, 5104 bp, Homo sapiens
gcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297508 - DNA, 4774 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297509 - DNA, 4877 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297510 - DNA, 4597 bp, Homo sapiens
tgcgcttccaacggggttctcgggtcatttcctagcgccggtcacactggttggcctcctcccctcaacatctcctcctccggctgcagagggggcaagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297511 - DNA, 4157 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297512 - DNA, 3147 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccg

SEQ ID NO: 297513 - DNA, 4891 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297514 - DNA, 4180 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgccgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297515 - DNA, 4090 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaaccgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297516 - DNA, 4769 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctccccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297517 - DNA, 3947 bp, Homo sapiens
  misc_feature (24)..(24): n is a, c, g, or t
  misc_feature (38)..(38): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297518 - DNA, 2359 bp, Homo sapiens
  misc_feature (24)..(24): n is a, c, g, or t
  misc_feature (38)..(38): n is a, c, g, or t
  misc_feature (2329)..(2329): n is a, c, g, or t
tgggttcccccggactggcagganttcgcggccgcgtncgacacggctgcgagaagacgacagaagggggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggctggctcnagtccagcatctccaacctggttttcacct

SEQ ID NO: 297519 - DNA, 2895 bp, Homo sapiens
gcggccgcctactactactactactactgctcgaattcaagcttctaacgatgtacggggacatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297520 - DNA, 3181 bp, Homo sapiens
tcgtcccccgccgccggccgctcgcccgccgaccaccgcggctacgccagcctgcgcgccgcctcgcccgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297521 - DNA, 3033 bp, Homo sapiens
  misc_feature (8)..(8): n is a, c, g, or t
  misc_feature (25)..(25): n is a, c, g, or t
  misc_feature (51)..(51): n is a, c, g, or t
  misc_feature (279)..(279): n is a, c, g, or t
taaccccntcaacttaaaggggaancaaaaaaccttggagcttcccacgcnggttggccgcccgcttcttagaactaagttgaatccccccggcttgcaaggaattcggcacgagtgttgaggggaggaggccaagccagtgtgaccggcgcttaggaaatgacccgagaaccccgttggaagcgcagcagcgggagctaggggcgggggcggaggaggacacgaactggaagggggttcacggtcaaactgaaatggatttgcacgttggggagctgngcggcggcggctgcttggcctccgccttcttttctacgtgaaatcagtgaggtgagacttcccagaccccggaggcgtggaggagaggagactgtttgatgtggtacaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297522 - DNA, 2922 bp, Homo sapiens
agctgcacttcctggttccaaatcctggctcttcccctcatccctgggtaagttgagggatgagagcaagagaaggttgatcctgactcagatctctgcatggggcatgtcactgatgacggcggcattccctgagagagggaacactaagtttgaagttgggcatagtgagcactattttggatgagttaagtttagaagtgcctgaagacatccaagtggaagaagtggctgcatggactgaagatacagactgggaaacgttaacaccatcaaggaactggagtcctgcacagcccttcaagacagagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297523 - DNA, 2603 bp, Homo sapiens
  misc_feature (115)..(115): n is a, c, g, or t
tgcaaagagaccaaagtggttctcagggtgggtgcacacagccccgcagtgcaccttgcacctccacaggattagggcttgccagccaccctcccccaagcaggaaaggaggagntttttttgttgttttttgagacatcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttctttttttttctttttttttttttttttgggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297524 - DNA, 673 bp, Homo sapiens
ttcaatttctacaccgacatattcatgctgtatgtgctcgccacccgctagttacatactagtcatctcagttatcagatcagttgttggagtattgcagcgcttgtgttcaagtaacctttattttatttaaaatggcaccaaagagcaagagtagcgatgctggcagttcacatatgcagagagaagccatatagtgcttcctttaagtgtagaaattgaacgttcaatttctacacctcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaacccta

SEQ ID NO: 297525 - DNA, 684 bp, Homo sapiens
ggaaattgtgttgttccggctgctttcaacgcgcgtgtgagcgtgagctttggacattgtgttttgatgtgtgtgagcgtgagttttggacgctgtgtgaagttgtgttttgatgtgtgtgagcgtgagtttggacgttgtgtgaagttgtgtcgtgtgtgtgtgtgagttttggacgtgcgaagttgtgttttgatgtgtgtgagcgtgagttttggactgtgtgcagttgtgtttgattgtgtgtgtgagttttggacgttgtgcgaagttgtgttttgatgtgtgtgagcgtgagttttggagttgtgtggagtgggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297526 - DNA, 364 bp, Homo sapiens
aattgattagtagagacaaacaaaaatatttttttcagaaaacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaa

SEQ ID NO: 297527 - DNA, 279 bp, Homo sapiens
  misc_feature (151)..(151): n is a, c, g, or t
aaagggctccagcccagaaggttcctgcccagatagccacaggccagaaagcagcgcctgctccaaaggctcagatgggtcaaatagctcctccccatgcagctctagggtccctacgcgttcctcggagatgcgacactggcgaattacnctgtgtcatcaaagtagtgatggattcagtactcctcaaccactctcctaatgattggaacaaaagcaaacaaaaaagaaatctctctataaaatgaataaaatgtttaagaaaagagaaagagaaaa

SEQ ID NO: 297528 - DNA, 496 bp, Homo sapiens
agaaagctcatgcgttgcattggtaatatgcagttacaggtttttaaaaatcctttcactccaagacttatggatacttacatacaggtttctttctgcagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaa

SEQ ID NO: 297529 - DNA, 3843 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297530 - DNA, 3885 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatatatatatatatatatatatatatatatatatatatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297531 - DNA, 3906 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatatatatatatatatatatatatatatatatatatatatatataatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297532 - DNA, 3681 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297533 - DNA, 3885 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgcaggagacgcagcggcggccgcagcagcagcagcaagacggaccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297534 - DNA, 3617 bp, Homo sapiens
tggtcgccggagtaaggatatgtcgaccagccgtcgccacgcgtcggcgcgaggctgtggggagtcggggcgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297535 - DNA, 3710 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297536 - DNA, 3808 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgcaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297537 - DNA, 3628 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgagcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297538 - DNA, 4053 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgagcttgatcctggatagtgtttgtatgatgtgcacacgtctctgcaaatgcttgtttgaagattggctgtgctgcattttggtataattgggaggtgacatattgtcccttatctcagtaaacatttggaggaagaggacgagaaagattgaattttgcattctttaattgggaagaaaaggaaggtgaatccatgttgagctgagctagtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297539 - DNA, 3790 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtctttttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297540 - DNA, 4020 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctcagcagccctgagccatcgagatattgtccaagttgtcataagcatctattgatgttcgccgagcctgattatcttcttctgtaataaaaagattgttccatgattcattcacagatttgttgttatggttctgaactgaacgccaatacggtttcacccgtggtagctgtttaaccttgctgaaataattgactgcacgagtgctgactccaccgtggagacagcaccatcagccaatcacttaaccacagaggcttgaattctaagtagaacagtattgctgagcgct

SEQ ID NO: 297541 - DNA, 3788 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297542 - DNA, 3804 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcaccttctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297543 - DNA, 3768 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297544 - DNA, 3750 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297545 - DNA, 3459 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactcagatacatccttgaatatgcattagtgttcattacagaaaactacaatcgatgttcacataaataaagtcaagatccaaacagaataccagttggagatgaagagtagatgggagtgattacattgaggtacagatcgaaaaccctcactaaccttatgaccacacacatca

SEQ ID NO: 297546 - DNA, 3575 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaacctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297547 - DNA, 3044 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcatgaaaacctctccgaaaagccttgaactgtttttctgctgatttattgagaatgtagtcagaataaagatgacagttccttcctgttttcatttgtaattggaatttata

SEQ ID NO: 297548 - DNA, 2519 bp, Homo sapiens
gagatcggtgcagcatctgccggtattatagatcggcgtacgaaaatacatgttccatatttataacagaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297549 - DNA, 2693 bp, Homo sapiens
aaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaatgttcagtggggtgtgtgggtgtatgtatgagggaaacagttctcaaaagaatgtcagaaaaaccatttttataaaattaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297550 - DNA, 2408 bp, Homo sapiens
  misc_feature (151)..(151): n is a, c, g, or t
aaagggctccagcccagaaggttcctgcccagatagccacaggccagaaagcagcgcctgctccaaaggctcagatgggtcaaatagctcctccccatgcagctctagggtccctacgcgttcctcggagatgcgacactggcgaattacnctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297551 - DNA, 2251 bp, Homo sapiens
  misc_feature (11)..(11): n is a, c, g, or t
  misc_feature (23)..(23): n is a, c, g, or t
ctcgtgcaatntcggcagcaagntactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297552 - DNA, 1714 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaa

SEQ ID NO: 297553 - DNA, 2284 bp, Homo sapiens
  misc_feature (2246)..(2246): n is a, c, g, or t
  misc_feature (2260)..(2260): n is a, c, g, or t
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtgcgtcaacatatctttcccctacttcctacttgtctccctccttttccctcccccccttctatcgtctacccctcgttttgcgtctcctatcctcctcccgtcccgcttgaggttttaattatatatgacttcccttccctctcaccacaatattttttactttcacgtgggtcccacagactccggcacccgctccccacacaacccacaaacccgccgaagcgacaacaacctagctgcgggctcgcgacacccgccccacccccaccctcctactttcccccngcctcacatttccnacattattatgatctctattttca

SEQ ID NO: 297554 - DNA, 2062 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtgattatttgcatcctaagaacttctctacttacaaagtactgaccggcctcatcagaaccccatagccctatttccctatagtggagtgcctattaagatcc

SEQ ID NO: 297555 - DNA, 1369 bp, Homo sapiens
aacgttagtcatagtcgaacgcctggtgcatcggcacaggacattttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297556 - DNA, 2184 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaaaaaaaaaaaaaaaaaaaaaaaaaaaaaaaaaaaaaaaaaaaaaaaaataaaaaaaaaaaaaaaagaaaaaaaaaaaaaaaacaagaaaaaagagaggggcgggcgggcgagtaatataatatctccaggcgggagggaagcaatagtacgcaccgacgacgaatgtattagagaagaagaggccccaaccagtgaggggggctaactatatataaagaaaagagcgaagggcgaggtagtattaaataaaaccaactgctgagagagggaaaagaagcatatgagagtagtatgtgttaggaagagacacaaactatgttggggaagaggaaaaaggaaggggacaaatactcagcaaagataaatagacgctgaggaacataaaacaacgagtatgttaatgttaaacgacgagatattatagtgggatagaagatatagctcgggaagataataaaaataattaggg

SEQ ID NO: 297557 - DNA, 952 bp, Homo sapiens
tctagaggatccctggagatcatgagtgttatagagagcaagaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297558 - DNA, 1353 bp, Homo sapiens
gctcgaatgcgaggaatcgctgccatgtaatcccagctctcaggcatattaagaggtggaaaaatacttggagcctgtgagttcgaaactggcctgtatatgttagggagagccgttctctagatagacggttgataatacataggttttatgagattaaacattttgggaatcccgtggtctacaaaacaactttgtatgccctagttggagtttgtgtccacacgcccataagtagggtagcaaaggtagacacatcgtgcacccccaagagagtcgtgaacgggactgtgtggctgggtgaaccccggagtaaaaaaacatggggggggataactgggctgttttgaaacagtaccggaatagagagaacagcgggacaactgggcctttgtgcaaaggcgagtccatagatcaggctgattgaaaaagccgcacggggtaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297559 - DNA, 987 bp, Homo sapiens
aatgcttgtggtatgtgttttccaaactgcccctctacctgctttgtccatgcagcctgatcataactgccttccacaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297560 - DNA, 1679 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgc

SEQ ID NO: 297561 - DNA, 2044 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaggacacaaaaagaaaggggagcgtttaaatttccaaaaaggtgggttaatttgggagaaattatcggagcttataaatggaattagctttagaagattaccaatgggcgattggcgtgggttccacgtaaaaggaatggttgtaccgagagggtggacgcttggaagttggtgcccacttttgaagggggaactctctggggtaccctgggaaaattggtgaattctggggaatatttacctggtgtgcatctaaaggtagtggagggggttccggggactccctcaaacaactcctctcttatatggagtgggggaccacaaagccgaaaaccaaaaaagaaaatctctctattataatcggtggcttacctggtgttaagaaaaacgagacgagagcagaagggggttttatttcaggggaaagggaggagtttgcggcctaagtgttgggaggtttggaggttttctgcgccggagttgggagttattttttgagaatcttcccgggctctttttaaacttttttccaaaataagggtctctaaaggaaaaacccagcgagaaacattagccctgtgggagaaaccatctggtgtgggggagcacaccttcttcccatttatgccttggggacataagatctcccg

SEQ ID NO: 297562 - DNA, 1639 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaa

SEQ ID NO: 297563 - DNA, 1490 bp, Homo sapiens
agcggggcggggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagagggtaagattgtggcatggtctactttttggattgatttctaggtaaaatcccattaaaaaattctcttagcacaaagccatttattctgtatttggagtcatcctgccaatcctggtttgaattgggttgggttagttacagcagattttttcaagaacattttgtgaaatttggggactgtagagatatctagtactgttttctctgtgttctttctacatttattgacaggtttttttggtcaaacattcagtaatgataattaacatttattgaccacgatatgcacttagcattataacaaacaatgttacacattatgcaacgagcagtgtttgtgcttaaggtcacaaatacaaaaaccctatgaggtgtagctaccattatttccctc

SEQ ID NO: 297564 - DNA, 173 bp, Homo sapiens
tgttactattcagtgagggaaggaattgattagtattaatttcctcctgtgctacaggtgctttttatattcatttaattctcacaactacaagaaaggtggtatcttcatttgcatccatttagcttattttgaatcacttctatttgccaggcactagggatacagcgatg

SEQ ID NO: 297565 - DNA, 327 bp, Homo sapiens
ccgacctcaggtgatctgcctgcctcagcctcccaaagtgctaggattacaggcatcagccaccacacccggctcgagtctctgatttttaaaactcttcataatacccctttatccaattcttcatagatggtaataacgtataattggtgacatttcacatcgctttgggcttataaagaatgtattttgacttcaggcatttgtgtttactgtgccatcagcctctagttcattttacttattcttttcttctccaggtttttcgttggaatatacgttgcacatttatggcgattctgagtgtgagggcagacttctgccagg

SEQ ID NO: 297566 - DNA, 164 bp, Homo sapiens
atgtgggaaactttaagagggtccagttgtacttcaacaaaatatcacaggtaacactgggagattctgaggcagaaacgaaagcaacatcttttcccactggtaacattctgaaaaacacccgagaaagagaagtcccccaaagcacagcaatacggccccgc

SEQ ID NO: 297567 - DNA, 1536 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcacttctgtgctccgcagagggtttctgcgccttcgccagcccaggtcgg

SEQ ID NO: 297568 - DNA, 1193 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggatgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttg

SEQ ID NO: 297569 - DNA, 2100 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297570 - DNA, 2462 bp, Homo sapiens
  misc_feature (2106)..(2106): n is a, c, g, or t
  misc_feature (2109)..(2109): n is a, c, g, or t
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggctaaaaaanaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataataaaaaaaaaatttccaataatgagacataatatcgattgattaaccgttagagttcaaagttcaaaaccgctttaaccctgaaataacccaatttaacttgacatgggacacatatcagctaaattgaccttctttaaaaattaacaaactttgaaaaaaccgcgctttttaccattttcccaacttgaatgaaaatctcaaaattgaaagccttattaatctgtaaaaattctcgaaaaattggaatttaaataaga

SEQ ID NO: 297571 - DNA, 2149 bp, Homo sapiens
  misc_feature (76)..(76): n is a, c, g, or t
tcaaagacgaaagcaacaacgacccaccgcacacacacaacaacaaagagaaccaaaaggggcaggtacgaggccnggtgttctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297572 - DNA, 2122 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagccagcagcagcagcagcagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297573 - DNA, 2287 bp, Homo sapiens
  misc_feature (76)..(76): n is a, c, g, or t
tcaaagacgaaagcaacaacgacccaccgcacacacacaacaacaaagagaaccaaaaggggcaggtacgaggccnggtgttctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctgggctcaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297574 - DNA, 1977 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297575 - DNA, 1695 bp, Homo sapiens
gcgtgattagaggatcccggtggcgaggagggtcggtacgtcacagacggacggcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297576 - DNA, 1593 bp, Homo sapiens
cggagtcgggcaggagccaagcctgcttacaattctacccatctcccatcccttaccacccatctctagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297577 - DNA, 1480 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297578 - DNA, 997 bp, Homo sapiens
ctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297579 - DNA, 895 bp, Homo sapiens
ggatccgcggtaggttcgatcgcacgtcgttggtctcgacgctcgaatgaggaggaggtggcctgtgttgagatggaggaatgatgagtgatctgaaactggggatgaggcggatgaggatggacagaggacggaacgcatgaggaggattgatgtgcccgggacaggctgagtactacgtgttcagatgactgcctccatggcgtgtggcactgagtgcctgatccgggtcctggcgcattagtgttggctcgcggccaagaatagagtgttctcgtgatgacgaactcgcaacgaaacattgcagttatgtccttaccatgttctggcttcgtgcactttgtccggtggatttggtagtgtacgctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297580 - DNA, 993 bp, Homo sapiens
gcgcggaagtggcggcggcgcgcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctgggctcaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgatatcctcctggcggtccctgctggggggagtgggcaaggggccctctggttcaacttgccctgagtcctgttcctcttgggagtttgtcttataccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 297581 - DNA, 245 bp, Homo sapiens
cgacctcttcctgaccttgtatgactgggtttgggggctatcattgtagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctt

SEQ ID NO: 297582 - DNA, 804 bp, Homo sapiens
ctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggtgcggcctgggctaaggggagacaagggaggctggtggaccaggcctgggccggtagcgggaaccccgggggcggcccagctgggtcctccgagagccggccgccatcgtgtgctttctcacaggagagaagccgggggatgtttcattcattcggccgaggccatcgagctacagctatgggccaggctcgggctgcaggtgttcgtcctcgtggcccttcctggctggcgaggagaagagctgcctatgggacagagctgcggtcctgagctgcagtagcgcctgggaggcactacagggttggaatccagattactcccttcccagaccacgtctcagggtggctgggggtacaccccagagtggggctgagcattctccattctctctgccaggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctg

SEQ ID NO: 297583 - DNA, 463 bp, Homo sapiens
ttttggaactccccaaagagctgtcagaaatctttgatcccacacgagtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatcta

SEQ ID NO: 297584 - DNA, 349 bp, Homo sapiens
ccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggct

SEQ ID NO: 297585 - DNA, 2499 bp, Homo sapiens
ggatcgatttgagtaagagcatagctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297586 - DNA, 2617 bp, Homo sapiens
gaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297587 - DNA, 2594 bp, Homo sapiens
aaggctggtactggccgagatctaggatccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297588 - DNA, 2608 bp, Homo sapiens
atggggaactgcatcagctctgtgaattcttgcaatctattgcctgggaaagtgtcttgcacattaaacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297589 - DNA, 2610 bp, Homo sapiens
cactggacttcagccttggacaaaaacactagcagaactatttatgatcctgtacatgcatctccaaccacttctatgcgtgtgttttatattagtgtaggggcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297590 - DNA, 2563 bp, Homo sapiens
gaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcacgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297591 - DNA, 1366 bp, Homo sapiens
gaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcacagcgttccttgtctacgcctcgatacgctcccttttgtgacctctcctgtacaccacacatcat

SEQ ID NO: 297592 - DNA, 3205 bp, Homo sapiens
  misc_feature (100)..(100): n is a, c, g, or t
ggatcgatttgagtaagagcatagctgtcgggagagcccaggattcaacacgggccttgagaaatgtgagtaagggtgatgggcaaccaggtgggagggngaagccaggggagaagccagggcatgggaggcaattcagggagacaggaacacccttctctcttcacacacctcatcagttccactgtgcacacgcgtggacacacacaacacacgccccatccctcctcctagggatcagaggagacttcatacatagatgctcatgccatggtcctttcttccctctgggctcttggcagggagcagcgagaggaggggaccccttgcccaggacgggacactctgtgcctgtgtcccccactccacagatggtttctcccagacgctcttgctgaacctgtgggagccctttcagagacccacgggtggaaaccctcaccctccattaactggtcccaagccagtcctattcctggaaggggaggggagggacgcgtccgggcaggggaggaggctggaaagggagtgtgaggggagtgtggtggcctctggactggacactgccctggagagtgacccgatgcagcagctgcacaggccatcctccccacccacgcacccctgctgagaacatgtctgtgaggttcagggtgggcagagaggagaatgcccagtggtatggccgtctcatcccctgccacagccactgcccacatggcaagagtgctgaacccctccagctccagatactctcttttgttttggcaggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297593 - DNA, 3512 bp, Homo sapiens
  misc_feature (100)..(100): n is a, c, g, or t
ggatcgatttgagtaagagcatagctgtcgggagagcccaggattcaacacgggccttgagaaatgtgagtaagggtgatgggcaaccaggtgggagggngaagccaggggagaagccagggcatgggaggcaattcagggagacaggaacacccttctctcttcacacacctcatcagttccactgtgcacacgcgtggacacacacaacacacgccccatccctcctcctagggatcagaggagacttcatacatagatgctcatgccatggtcctttcttccctctgggctcttggcagggagcagcgagaggaggggaccccttgcccaggacgggacactctgtgcctgtgtcccccactccacagatggtttctcccagacgctcttgctgaacctgtgggagccctttcagagacccacgggtggaaaccctcaccctccattaactggtcccaagccagtcctattcctggaaggggaggggagggacgcgtccgggcaggggaggaggctggaaagggagtgtgaggggagtgtggtggcctctggactggacactgccctggagagtgacccgatgcagcagctgcacaggccatcctccccacccacgcacccctgctgagaacatgtctgtgaggttcagggtgggcagagaggagaatgcccagtggtatggccgtctcatcccctgccacagccactgcccacatggcaagagtgctgaacccctccagctccagatactctcttttgttttggcaggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagggtacagccgtcctacccctgaaagaccccttcctccccttctgtctgcacttggctcctcttgtcccaacttcctcctggatcccctggccagctggggcaggaacggccaacatcacccatgggctgggtaagttcccacacaactagaattgggtcatggggatcccttttcaccttcccctgaaaacacacataaggcaggatttcatcaccaccaccaccaccctggccaccaggctactacccagttggccctgtgtaaaaacgtccaagctgaaaaaaaaaaaccctcctcccctactagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297594 - DNA, 3080 bp, Homo sapiens
  misc_feature (344)..(344): n is a, c, g, or t
  misc_feature (354)..(354): n is a, c, g, or t
  misc_feature (550)..(551): n is a, c, g, or t
  misc_feature (568)..(568): n is a, c, g, or t
  misc_feature (619)..(619): n is a, c, g, or t
  misc_feature (673)..(673): n is a, c, g, or t
  misc_feature (710)..(710): n is a, c, g, or t
cgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcggagggcaaaaagccaagatgggcaacttcccctggcaggtgttcaccaacatccncgggcggggncggggcctgctgggcgacgctggatcctcacagctgcccacacctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaatttnnagggggacatcgcctgntggagctggaaaatagtgtcaccctgggtcccaacctcctccccatctgcntcctgacaagataccttctacgacctgggcttgatgggctatgtcagtggctcngggtcatggaggagaagattgtcatgacctcaggttngtccgtctgccgtagctaatccacaggcctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297595 - DNA, 2681 bp, Homo sapiens
aaggctggtactggccgagatctaggatccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtgggtctctggtgagtgacctccctaagatcagagccactactcaggtctcccagcagaagcttaaccctccttcctgaatgccttccagaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297596 - DNA, 2411 bp, Homo sapiens
  misc_feature (344)..(344): n is a, c, g, or t
  misc_feature (354)..(354): n is a, c, g, or t
  misc_feature (550)..(551): n is a, c, g, or t
  misc_feature (568)..(568): n is a, c, g, or t
cgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcggagggcaaaaagccaagatgggcaacttcccctggcaggtgttcaccaacatccncgggcggggncggggcctgctgggcgacgctggatcctcacagctgcccacacctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaatttnnagggggacatcgcctgntggagctggaaaatagtgtcaccctgggtcccaacctcctccccatctgccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297597 - DNA, 1810 bp, Homo sapiens
  misc_feature (24)..(24): n is a, c, g, or t
gaatgtcgagctacggtacccacncggagcgtggaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297598 - DNA, 932 bp, Homo sapiens
  misc_feature (925)..(925): n is a, c, g, or t
  misc_feature (930)..(930): n is a, c, g, or t
gaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcgtaacctgactaagttctgagctttgaatgatacacagaagtcatgcctatacactcgattngcacnga

SEQ ID NO: 297599 - DNA, 1292 bp, Homo sapiens
gaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcgccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297600 - DNA, 2195 bp, Homo sapiens
caccggcaggttgtactccaccgggagttgtactccaccgggaggttgtactccaccggcagttgtactccaccggcaggttgtactccaccggcaggttgtactccaccggcaggttgtactccaccggcaggttgtactccaccggcaggttgtattcctggagccttttgatattgatgaccaccagcaagtacactgcccctatgaccagctacagggtacagccgtcctacccctgaaagaccccttcctccccttctgtctgcacttggctcctcttgtcccaacttcctcctggatcccctggccagctggggcaggaacggccaacatcacccatgggctgggtaagttcccacacaactagaattgggtcatggggatcccttttcaccttcccctgaaaacacacataaggcaggatttcatcaccaccaccaccaccctggccaccaggctactacccagttggccctgtgtaaaaacgtccaagctgaaaaaaaaaaaccctcctcccctactagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297601 - DNA, 1717 bp, Homo sapiens
ctagcggatccttatgaggcaggacactgcccgtctgaccatgttacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297602 - DNA, 1453 bp, Homo sapiens
  misc_feature (344)..(344): n is a, c, g, or t
  misc_feature (354)..(354): n is a, c, g, or t
  misc_feature (550)..(551): n is a, c, g, or t
  misc_feature (568)..(568): n is a, c, g, or t
  misc_feature (619)..(619): n is a, c, g, or t
  misc_feature (673)..(673): n is a, c, g, or t
  misc_feature (710)..(710): n is a, c, g, or t
cgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcggagggcaaaaagccaagatgggcaacttcccctggcaggtgttcaccaacatccncgggcggggncggggcctgctgggcgacgctggatcctcacagctgcccacacctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaatttnnagggggacatcgcctgntggagctggaaaatagtgtcaccctgggtcccaacctcctccccatctgcntcctgacaagataccttctacgacctgggcttgatgggctatgtcagtggctcngggtcatggaggagaagattgtcatgacctcaggttngtccgtctgccgtagctaatccacaggcctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtg

SEQ ID NO: 297603 - DNA, 316 bp, Homo sapiens
aaagggtgaggtacccagtccaggacaacacgcaaagagtgaatcagtgggagactcagggaacagctgaaagtcacatggggaagtttgcagcagctgagcccagcaggtagtgaccagccagagccattgcggtgcatgatgcactctgggcgagacaaggaggaccatcactgagccaccacgtgcgccactccgcaacagatcttcttcctacccactgtccttcttccaccagatctctgctgataagaaaagcctggggaggttctgtgggcaactgggttctccactgggcaaccccccgggaaagaag

SEQ ID NO: 297604 - DNA, 1717 bp, Homo sapiens
  misc_feature (1717)..(1717): n is a, c, g, or t
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgcccttcgtgcggtctacgtacgacgagctcaagaaggtatctaagaagtcctcggaacagcagacan

SEQ ID NO: 297605 - DNA, 1705 bp, Homo sapiens
  misc_feature (1622)..(1622): n is a, c, g, or t
  misc_feature (1678)..(1678): n is a, c, g, or t
  misc_feature (1705)..(1705): n is a, c, g, or t
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcaccccaaccatgcagacacgngttgatgaatcgggcacttcgtgcgtgcagcgttatgcaactgagcgcgtacatgnagagctcaacgggactgtgaaacagtn

SEQ ID NO: 297606 - DNA, 1696 bp, Homo sapiens
  misc_feature (1611)..(1611): n is a, c, g, or t
  misc_feature (1619)..(1619): n is a, c, g, or t
  misc_feature (1678)..(1678): n is a, c, g, or t
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaaanccaatgcngaagaaacgaacggggggttctgcaacttgaaaatccgggggggcgaaactttccggcntgcccgggttgccccaag

SEQ ID NO: 297607 - DNA, 1568 bp, Homo sapiens
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctacttgtcgcttcacgcgcttgtctcgaaccccggcagcgtcgttccgcctatcttaccgctcgctctgtcttcactatgtcaccgtcttcccctctgcccttgatcctctccacatctgtctccccacacgccgccaccttccactctccttctcctcccctaccatcctttgtgacttcctccttctacctaccataccttccacgcgctcttctattcttctgcccccttccaccgctccccttctactcacgagctcccggactatccatcccctcctactctctcctctacgcctctccctctcc

SEQ ID NO: 297608 - DNA, 1407 bp, Homo sapiens
  misc_feature (1347)..(1348): n is a, c, g, or t
  misc_feature (1368)..(1368): n is a, c, g, or t
  misc_feature (1380)..(1380): n is a, c, g, or t
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttnncgggcctggctccctccggnccccccccctgntggccaaaacgaacgggacctgcgtga

SEQ ID NO: 297609 - DNA, 2937 bp, Homo sapiens
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagaaaaaaaaaaaaaaaaaaaaaaaaaaaaaaaaaaaaaaaaaaaaaaaaaaaaaaaaaaaaaaaaaaaaaaaaaaaacaagaaggaaacgaaagcaagaacacacacaaacacgaaagaacaacacaagaaacaaccaaaggggggcggcggcgccacaacaaataaaatcatccccgggggggagccacacatgtgatagccaccccccatattgtctgaagagacgagcccccccccacgctgaacggcgatttaattcaaacaagcgacgaccgggcccacgttaccaagccacccccacgcgacacacaccgccggaggctgactgtcggagcgcaaccccactctgtcgggcggggggacaacagagggcacccacccccccagagataccggcggcggccgaataaacacgtcgcggcggtgtggggaccaccaccatcttggcgggaaacggcgcgacgattacaatac

SEQ ID NO: 297610 - DNA, 2555 bp, Homo sapiens
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagagtaagagaaataagtatgttattctaaaatctaaactcaaatgaaatttcaaaaaagaccaaaaaaaaacaaggcaacagaaccagggctca

SEQ ID NO: 297611 - DNA, 2718 bp, Homo sapiens
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagaaaaaaaaaaaaaaaaaaaaaaaaaaaaaaaaaaaaaaaaaaaaaaaaaaaaaaaaaaaaaaaaaaaaaaaaaaaacaagaaggaaacgaaagcaagaacacacacaaacacgaaagaacaacacaagaaacaaccaaaggggggcggcggcgccacaacaaataaaatcatccccgggggggagccacacatgtgatagccaccccccatattgtctgaagagacgagcccccccccacgctgaacggcgatttaattcaaacaagcgacgaccgggcccacgttaccaagccacccccacgcgacacacaccgccggaggctgactgtcggagcgcaaccccactctgtcgggcggggggacaacagagggcacccacccccccagagataccggcggcggccgaataaacacgtcgcggcggtgtggggaccaccaccatcttggcgggaaacggcgcgacgattacaatac

SEQ ID NO: 297612 - DNA, 2832 bp, Homo sapiens
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagaaaaaaaaaaaaaaaaaaaaaaaaaaaaaaaaaaaaaaaaaaaaaaaaaaaaaaaaaaaaaaaaaaaaaaaaaaaacaagaaggaaacgaaagcaagaacacacacaaacacgaaagaacaacacaagaaacaaccaaaggggggcggcggcgccacaacaaataaaatcatccccgggggggagccacacatgtgatagccaccccccatattgtctgaagagacgagcccccccccacgctgaacggcgatttaattcaaacaagcgacgaccgggcccacgttaccaagccacccccacgcgacacacaccgccggaggctgactgtcggagcgcaaccccactctgtcgggcggggggacaacagagggcacccacccccccagagataccggcggcggccgaataaacacgtcgcggcggtgtggggaccaccaccatcttggcgggaaacggcgcgacgattacaatac

SEQ ID NO: 297613 - DNA, 2883 bp, Homo sapiens
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagagcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagaaaaaaaaaaaaaaaaaaaaaaaaaaaaaaaaaaaaaaaaaaaaaaaaaaaaaaaaaaaaaaaaaaaaaaaaaaaacaagaaggaaacgaaagcaagaacacacacaaacacgaaagaacaacacaagaaacaaccaaaggggggcggcggcgccacaacaaataaaatcatccccgggggggagccacacatgtgatagccaccccccatattgtctgaagagacgagcccccccccacgctgaacggcgatttaattcaaacaagcgacgaccgggcccacgttaccaagccacccccacgcgacacacaccgccggaggctgactgtcggagcgcaaccccactctgtcgggcggggggacaacagagggcacccacccccccagagataccggcggcggccgaataaacacgtcgcggcggtgtggggaccaccaccatcttggcgggaaacggcgcgacgattacaatac

SEQ ID NO: 297614 - DNA, 1879 bp, Homo sapiens
cggacgcgtgggccgggtactcgggaaaggactgccagaaaaaggacgggccctgtgtgatcaacggctccccctgccagcacggaggcaccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagaaaaaaaaaaaaaaaaaaaaaaaaaaaaaaaaaaaaaaaaaaaaaaaaaaaaaaaaaaaaaaaaaaaaaaaaaaaacaagaaggaaacgaaagcaagaacacacacaaacacgaaagaacaacacaagaaacaaccaaaggggggcggcggcgccacaacaaataaaatcatccccgggggggagccacacatgtgatagccaccccccatattgtctgaagagacgagcccccccccacgctgaacggcgatttaattcaaacaagcgacgaccgggcccacgttaccaagccacccccacgcgacacacaccgccggaggctgactgtcggagcgcaaccccactctgtcgggcggggggacaacagagggcacccacccccccagagataccggcggcggccgaataaacacgtcgcggcggtgtggggaccaccaccatcttggcgggaaacggcgcgacgattacaatac

SEQ ID NO: 297615 - DNA, 1926 bp, Homo sapiens
  misc_feature (1651)..(1651): n is a, c, g, or t
  misc_feature (1670)..(1670): n is a, c, g, or t
  misc_feature (1761)..(1761): n is a, c, g, or t
gagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctctcatgttgcctctccgcagggttacatcgtgggagaaggaactgccgatggataacacaggacgcggacgcctgatgctgtagtcacaccggtcgtccccctcttggcactagacaccagtgagagcaatccttgacagatagggaatgaatgaatgtggtcgcgtggtctcttccacgaatgcgctcatcgctgctcgtgttgtccgccacgcgtggactatcttcaagngtctaatttatcatgtcgnagagtcggttgagcgcaaagcagtcatgcgagtcccgctaaccgcgatgtcggacgcaagctggaccgtgactgctacctcgtccatcctngtagccattcagcgctgttgcgccgacctttccctgctggtccgggctagcccccatgggcccgcgtcgtttccgatgccgcaccgagaggcatcccgttggcatagcccggtccctccgggtggaaccgctaagcttgtcggccccaaggccgagccccccgtg

SEQ ID NO: 297616 - DNA, 4990 bp, Homo sapiens
  misc_feature (13)..(13): n is a, c, g, or t
  misc_feature (15)..(15): n is a, c, g, or t
  misc_feature (23)..(23): n is a, c, g, or t
  misc_feature (107)..(107): n is a, c, g, or t
  misc_feature (157)..(157): n is a, c, g, or t
acagaggtcattnantctttggnaattattatttataaagcactggactatggtttgaaggagaatgaagaaagggaattaagccctcccctagagcagcttatcgntcacatggccaacacggtggaagctgacggtagcaatgatgagggctatnaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 297617 - DNA, 4583 bp, Homo sapiens
  misc_feature (13)..(13): n is a, c, g, or t
  misc_feature (15)..(15): n is a, c, g, or t
  misc_feature (23)..(23): n is a, c, g, or t
  misc_feature (107)..(107): n is a, c, g, or t
  misc_feature (157)..(157): n is a, c, g, or t
acagaggtcattnantctttggnaattattatttataaagcactggactatggtttgaaggagaatgaagaaagggaattaagccctcccctagagcagcttatcgntcacatggccaacacggtggaagctgacggtagcaatgatgagggctatnaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattaggaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 297618 - DNA, 4569 bp, Homo sapiens
ataataagctgatctggggcatcagtctgattacaggcgtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 297619 - DNA, 4936 bp, Homo sapiens
  misc_feature (13)..(13): n is a, c, g, or t
  misc_feature (15)..(15): n is a, c, g, or t
  misc_feature (23)..(23): n is a, c, g, or t
  misc_feature (107)..(107): n is a, c, g, or t
  misc_feature (157)..(157): n is a, c, g, or t
acagaggtcattnantctttggnaattattatttataaagcactggactatggtttgaaggagaatgaagaaagggaattaagccctcccctagagcagcttatcgntcacatggccaacacggtggaagctgacggtagcaatgatgagggctatnaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacatttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 297620 - DNA, 3877 bp, Homo sapiens
atacaaacagcttctctgctcagctctcatccttttgaagcagccatgtttggggtagcaggggctatgtattatctgtgtgagagagcttttaccagcaggtggaaatcctcaaaggaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 297621 - DNA, 3915 bp, Homo sapiens
cttatgttctgacccacccttatgttctgacccaccattgggaaacctgttctcttctctgaagctactaatcaggggtctgatctgaagggaaattttgcacttccagaacagggggtaggaatctcttattcacgtgacattttgaatttcaggaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 297622 - DNA, 5182 bp, Homo sapiens
  misc_feature (13)..(13): n is a, c, g, or t
  misc_feature (15)..(15): n is a, c, g, or t
  misc_feature (23)..(23): n is a, c, g, or t
  misc_feature (107)..(107): n is a, c, g, or t
  misc_feature (157)..(157): n is a, c, g, or t
acagaggtcattnantctttggnaattattatttataaagcactggactatggtttgaaggagaatgaagaaagggaattaagccctcccctagagcagcttatcgntcacatggccaacacggtggaagctgacggtagcaatgatgagggctatnaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctacatagtttccacagggtaattcactaagagcttgtggagcttggttttaaaatccttagcctggtctgactttaggcatagcttccagttcttccttccttgtcctggtttcttgttcagcttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcagactttctgtgttgagttgctatcgtaagacggtgatgtcttttggtaattagctgtcagaaatcacctcaattgggaaggcagggtacttttataagcagcctgtgatctttgaagaaatacagtctaggccgggcatggtggttcacgcctgtaatcccagcactttgggaggctgaggcagacggatcacc

SEQ ID NO: 297623 - DNA, 3710 bp, Homo sapiens
  misc_feature (13)..(13): n is a, c, g, or t
  misc_feature (15)..(15): n is a, c, g, or t
  misc_feature (23)..(23): n is a, c, g, or t
  misc_feature (107)..(107): n is a, c, g, or t
  misc_feature (157)..(157): n is a, c, g, or t
acagaggtcattnantctttggnaattattatttataaagcactggactatggtttgaaggagaatgaagaaagggaattaagccctcccctagagcagcttatcgntcacatggccaacacggtggaagctgacggtagcaatgatgagggctatnaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgcttttt

SEQ ID NO: 297624 - DNA, 369 bp, Homo sapiens
ctgaatcactcagccatttactccccactttattgatttgaaatgtatccttggtaattacacttcactaattttatggcatatttgagataacagctatacccagaaattcatgatagtcttatatagtcacatgaatcttctgctttttgtctccttttaggtgaatggtgatattccccctcggttaaaaaagagtgctcatgaaatcatcctcgacttcatcagatccagacctcctttaaatccagtatgtaattcgacatagttctctagattggagatatcataatgaattattctactctagggtgtcatctctagaactcagctttcctaggtggtttttcctctgagctttttactctg

SEQ ID NO: 297625 - DNA, 2687 bp, Homo sapiens
agagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctaaaccttttatcttcgtgttggcactgttgccatccccgccctctcccgacatccccgcccttgaccagcatccctggccttgcccagcattgtctatgtattggcactcttgccatccccgccctttcccagcagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatgaagcttaaaaaaaaa

SEQ ID NO: 297626 - DNA, 655 bp, Homo sapiens
  misc_feature (503)..(503): n is a, c, g, or t
  misc_feature (509)..(509): n is a, c, g, or t
  misc_feature (518)..(518): n is a, c, g, or t
  misc_feature (521)..(521): n is a, c, g, or t
  misc_feature (595)..(595): n is a, c, g, or t
agagccgcgggatttgcggccgccgccatgccgtcgtccccgctgcgggtggcggtggtgtgctcgagcaaccagaaccggagcatggaggcgcacaacatcctcaggtagttgggctccaccctgtccccgcgcgctctgctccggcgaccggccctccctcctccccggttccccctggcccgcgccaggacccctgagaggaagccgggccgggccgcgctcgtgggtcggctggttgggatggcagctggacggcagcgcgcgtagtccacacgcgggtgggcatcacagggaaggcaggttccgggacgaggcgcccgctgtccggtggtccttcgagctctccgaggccgggcccgggggcgagggtagcgtccgccgctccagcgccgcgcagccaccgccgccgccgccgcctctccttagtcgccgccatgacgaccgcgtccacctcgcaggtgcgccagaactaccatcaggactcagaggccgccatcaancgccanatcaactgnagntctacgcctcctacgtttacctgttcatgtcttactactttgaccgcgatgatgtggctgtgaagactttgcanatactttcttcacatctcatgaggagagggacatgctgagaactgatgaagtgcagacca

SEQ ID NO: 297627 - DNA, 2004 bp, Homo sapiens
agagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatgaagcttaaaaaaaaa

SEQ ID NO: 297628 - DNA, 227 bp, Homo sapiens
gctgtaagatccacaagagtagagacaattgctggccgtgcttatcactgtggacccaaagcctgaagtagcatctggttcattaaacacatgatgaatatatgttgaataactaaatgaatgaaaacaccgttcttcaagctcccactaacaccttaccactctctaccatgtcaacttattttattataacaattgctcatcattaaaccgtatggtcctggaag

SEQ ID NO: 297629 - DNA, 2082 bp, Homo sapiens
  misc_feature (439)..(439): n is a, c, g, or t
  misc_feature (500)..(500): n is a, c, g, or t
  misc_feature (1311)..(1311): n is a, c, g, or t
  misc_feature (1459)..(1459): n is a, c, g, or t
agtctcatattatacaactggaatatgagttcaataaactcatgtttattttaggtgctacaacaggcattcttaatagtattttatatttacttgtgtttatcttgtagctcacgtcccctttaccccaaagtgagtaaagtgctgtagaatctaggatttggtcatatcacaattattgataattttcaacgatacaaatgaacatttccaatacacaatgccaagaacagaagtgttaaagggaagggatggcagagcagtgggtaaggtcacaggcagaagtaagaggcgaggccaaggaaggtttcagctgggacctggggaaagtggggtgggactttgcaagttgagaggacagcagactccaaagctcggaggaaagagggcaggggtctggggaatacgagacagcctgtgtcactgggcagtgcagccnggggtggtcaggaaggggcctgactaggaagttcattctaatgatgacagagacacagcantttgggcagaaatatcccatgttcaatttctgtctaggatgatccttctggtatgaagcacaggttaggggaaataatgggggtatggaaactgtcaagaggctgctgcccctggccagtagaaagagagtcaaggccagcccaggacaggaacaacagggagggaaagaaagtgaagaccctgaggagagagaggtgagaggtcagaggcagtagctgatggatgggggcgagggtgggaggaaggcccagggacagtgttagagaggccaatgtgtgtctgtccagcccctggcccctgggactcaggctacgcaccttcatgccctcccctgcagctgcatgcattgagattggtcaacggatgctcgctgttctcttgggtccctaagctagaatgaagcaaccttggggcaactcatggctgtgtccagctcctccaagggagcagaagaggaaccaacaggcagagaggagaagaccggaaagccagagagtgatcgggagagagaaacgcaggggctatttgtccctgacacagatgctgagttctgccagttcctcatgggtttctctcactggcaaccaaaggagtcttgactaaattaaataccacgctggctctggcgagagcggccagggagatggtggtgctatcatcaaaagaagcatcccaggaggaagaaaaaaagtttggaagcacatcgtgtcaacatatcccagtaaatgcatacagcaggcacttctacctaagcatatgaaccagatttcttattcatttttcatgtattctctgttgggttttgtattnaaatattttccaaaattgtaaaacacaaatcttatttaagaagtgccagaaaactttcaaggatattataatttgttttgcacttctagaaataaattgctttaaaaaaatcaataaattctcagtattactgttactagaactcgcngaatagaattatccagctgaacacaattacgatgcttatctagtcaacagtcagagacctgagcctctggggcaaggctacttggcagtacatgttgctcttataccactccttggggacgccgaggggaaggtggtggcaggagacaggacacatgggcagggccacgccataacagagaacaggagaagttgaggggaggcaagagaggaggcaagtgagcatggtcttcctcactggggaagaaactcgtaggctgcctggagcaaccatcagaggctctctggaagtcctgccgtttggcgccatcatggaaatttctggatgaagaaaggccacatttcaaaacctgctgcagatctggctgtcccctgcatgagctccctctgccagcaaggccttgcagccagtgccaagtctcaaccagagggagccacagtattcactggctcagtgctatgttcaaattcctccatgtgcctacagtggaatttcaatcaaaatcagcttatccttctctttcctttgcaatctgagtgtggtgccagccatctctcaaccccacagcaatggagtatctggagcgcaaggaggggttacagcttcttaatttcttatttctt

SEQ ID NO: 297630 - DNA, 1686 bp, Homo sapiens
  misc_feature (1)..(1): n is a, c, g, or t
  misc_feature (5)..(8): n is a, c, g, or t
ngcannnngctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaagca

SEQ ID NO: 297631 - DNA, 2865 bp, Homo sapiens
  misc_feature (943)..(943): n is a, c, g, or t
  misc_feature (1065)..(1065): n is a, c, g, or t
  misc_feature (2324)..(2324): n is a, c, g, or t
cttgaacttttggccttgagtaatcctcccaccttggcctcctaaagtgctgagattacaggcatgacccactgcccccagtccccattttctttaaaaggcctgaacatttccttcctcgtgtcagtcctgaacaattcacattttcagggctctgctcacaggcctgtgacttagcctgcctgcctatgaaaccattagcaaattggaaatacctcttgcaccagtcagaagggggattggtttctcttatatgcacatacattgggtctactgcacaaattacagggctccaagtgtcttatgagagcaggacttgggctgaccatgtctctctgccctcacccatgctctgctctgatttcagatcctaagtgtgaacgtgaagtccccagccctgctgctgagccagttgctgccctacatggagaacaggtatggcagggcgggggtggggaccagtcggagttggggacctgaggtgggcacagaaatacagtcggtagcacagccagtagtgggtagaggacagaagaggtctgggatctccacatccctcatcttcttgtcctgcctccccatctgtgtggctgccattcccaattccagtggctgcaggatgagagtagtattccaggggcccaggcatagcctccttggccttgacatcagcaggtttgggacaaggctatgctttaactccttgaccttgtgggctggtcattgtcaccttacctgctctctgttcttaccaacttaaaaccaatgacagggttagccccattcctctccataggaaaaagcctgtcccagacctctcctcatgcctgcgcttggtctccagggaccctgcctgtgttccaggtcctgcagatctgactgtacccctcacagacacacccttaggaactggccaggggctgtcttcagtagaaggaaagtncctgactgtcacttctggtctcccttaccccatctgctccttagaggttgctcattgataggcactcaccatcagccttgggtgcctcttcacaaagcccaccctgccctctccttcaagcncctggcaagagaggaagcagaagataagggttctgagcatggacatcgtatttatgagaaataggcatggaatcctagctctgccgtgtattggctggtactaaacctttctgagcctcagttttctgaactctgagatggggacagtaataggacctgtgttgcttctgtgagggttgcatcatttaatgaactcatgatagtgtcaccatcagtggtaagctcttagcttcagcttctcttatgtttgtcttgtctcaggaggggtgctgtcatcctggtctcttccattgcagcttataatccagtagtggtaagtgcttggtccttgtgctcctgagtggtatagggtgaggggcaactttgttcttttcctcagagccttacagacaaagtgcctgggacagacccccaccatcctcctgctgccctgggctgagcttgtctccatgtgggtgggagggctgctgggcctgtgagatccctgtaggtgagaaatccaactgatgctttcccccactctcccatatcctaatcactctgtcaattcccttcccaggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattgggtgtgtcttccatctcccagtctggctcagtgggaacccttcccagtgaataagggatcaaggggtgactgaatccttaggtcagcatgcctatgactgaggtcctcattgttctctgaactcagccatggtgcagtccatccatcctgaaaagatgctccttcttttgagaagggcaaagctgccctaggtgttctgcctggtggccttcccggggccctgcccatcttgttttagtagcactgactccttcatttcttccctttgcccagtttcatgggaatgagtctctctggaagaacttcaaggaacatcatcagctgcagaggcaagtggggtttggagatttggtggtccatgtgtggctaggcaggggcagttgagtctattgcaagagcagacccctccctgtcatctggccattgtttttgctgaaatctggagtccacatggccctggagggtgcaagtagccctgctgcatccaccttgttccccatggagcccactcccacctgtcatccgtgagccccagagcagcagaatcagagtacnagatgcttgacactgtgtccttcttccatccaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaagca

SEQ ID NO: 297632 - DNA, 1344 bp, Homo sapiens
ctcagctgcagactgcctgacagaagggctgccaaactgcactccagacagacaggtgcacagccaggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaagca

SEQ ID NO: 297633 - DNA, 1425 bp, Homo sapiens
  misc_feature (1)..(1): n is a, c, g, or t
  misc_feature (5)..(8): n is a, c, g, or t
ngcannnngctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggaaacactcggtcgtaagactgggcggctgctccttgtccaagcccagacctgagggtgccggagactcgactcggggcagtggcacagcaaaacgatggggcactggctgcagaaaaccggtatacacacacgcggcacgacacaatgtcggcc

SEQ ID NO: 297634 - DNA, 940 bp, Homo sapiens
tgtgcctgtagcggagactgtctctcctagaagggggctcctcactgagtcccacacaaacttgccgacaggaccagatccagccatcagcattccgggggcttagacatcccagcctgctatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaagca

SEQ ID NO: 297635 - DNA, 2653 bp, Homo sapiens
gggtgccgcgcctgtagcactcccggaactggaactaggtgccagacggtccggaggcgggggccacgtcagcggggccacccagggctcgcggggtcccggtgggtgccatgcggaggggcgcgcttctggcgggcgccttggccgcgtacgccgcgtacctggtgctgggcgcgctgttggtggcgcggctggaggggccgcacgaagccaggctccgagccgagctggagacgctgcgggcgcagctgcttcagcgcagcccgtgtgtggctgcccccgccctggacgccttcgtggagcgagtgctggcggccggacggctggggcgggtcgtgcttgctaacgcttcggggtccgccaacgcctcggaccccgcctgggacttcgcctctgctctcttcttcgccagcacgctgatcaccaccgtgggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttctgctttatctctctgtccaccatcggcctgggcgactacgtgcccggggaggcccctggccagccctaccgggccctctacaaggtgctggtcacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgctagacagtgctggagacatagttgggggtggagaactgcccttatggagcttgcagtccagtgaggtggacagacctgtccccagacagtgatggcccaaaatggtcaggactttaatggaggaggtgaggtgttgaaagcacaggcagagtggtcagggctgaagtcggagaagcatagggactaggcccaatccagcctggaaagtcagggaggacttcctagaggaagggacatcgaactaagacctgaactatgagaaataggcaggaagaagttgtacctgactcatttttctcaggtgtctccagggagcaggacccatggagggacccctggtgtaggcctgggcgatagactcttcctcagcagcctggcaggcaggaaacagacataggaccccagcccagatctgaatggcatgggaggtgctgcccttaaccatgacaccattgtaagagctgtccacatttgtatgttgtgccctggaatcagcctggttgagctcaaatcccaacttagccacgtctggcctgtgtccttgggcagtcacactacctctctgattttgtttccttatctgtaaaatggtgatcatcataatacaacttcaaaaggatttcaggctgagtgtggtggctcacgcctatacacccagcactttggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagtaaga

SEQ ID NO: 297636 - DNA, 2664 bp, Homo sapiens
tatagtagtgggttaaacggcccgcccgggtagtcggaactggaactaggtgccagacggtccggaggcgggggccacgtcagcggggccacccagggctcgcggggtcccggtgggtgccatgcggaggggcgcgcttctggcgggcgccttggccgcgtacgccgcgtacctggtgctgggcgcgctgttggtggcgcggctggaggggccgcacgaagccaggctccgagccgagctggagacgctgcgggcgcagctgcttcagcgcagcccgtgtgtggctgcccccgccctggacgccttcgtggagcgagtgctggcggccggacggctggggcgggtcgtgcttgctaacgcttcggggtccgccaacgcctcggaccccgcctgggacttcgcctctgctctcttcttcgccagcacgctgatcaccaccgtgggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttctgctttatctctctgtccaccatcggcctgggcgactacgtgcccggggaggcccctggccagccctaccgggccctctacaaggtgctggtcacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgctagacagtgctggagacatagttgggggtggagaactgcccttatggagcttgcagtccagtgaggtggacagacctgtccccagacagtgatggcccaaaatggtcaggactttaatggaggaggtgaggtgttgaaagcacaggcagagtggtcagggctgaagtcggagaagcatagggactaggcccaatccagcctggaaagtcagggaggacttcctagaggaagggacatcgaactaagacctgaactatgagaaataggcaggaagaagttgtacctgactcatttttctcaggtgtctccagggagcaggacccatggagggacccctggtgtaggcctgggcgatagactcttcctcagcagcctggcaggcaggaaacagacataggaccccagcccagatctgaatggcatgggaggtgctgcccttaaccatgacaccattgtaagagctgtccacatttgtatgttgtgccctggaatcagcctggttgagctcaaatcccaacttagccacgtctggcctgtgtccttgggcagtcacactacctctctgattttgtttccttatctgtaaaatggtgatcatcataatacaacttcaaaaggatttcaggctgagtgtggtggctcacgcctatacacccagcactttggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagtaaga

SEQ ID NO: 297637 - DNA, 347 bp, Homo sapiens
ttgggatttgagctcaaccaggctgattccaggcacaacatacaaatgtggactgctcttacaatggtgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctagacacaggctcaagatggagacacaggctcaagatggagacacaggctcaagatggtcatgacacggtcaacacagccaatgtcagga

SEQ ID NO: 297638 - DNA, 1412 bp, Homo sapiens
gggtgccgcgcctgtagcactcccggaactggaactaggtgccagacggtccggaggcgggggccacgtcagcggggccacccagggctcgcggggtcccggtgggtgccatgcggaggggcgcgcttctggcgggcgccttggccgcgtacgccgcgtacctggtgctgggcgcgctgttggtggcgcggctggaggggccgcacgaagccaggctccgagccgagctggagacgctgcgggcgcagctgcttcagcgcagcccgtgtgtggctgcccccgccctggacgccttcgtggagcgagtgctggcggccggacggctggggcgggtcgtgcttgctaacgcttcggggtccgccaacgcctcggaccccgcctgggacttcgcctctgctctcttcttcgccagcacgctgatcaccaccgtgggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttctgctttatctctctgtccaccatcggcctgggcgactacgtgcccggggaggcccctggccagccctaccgggccctctacaaggtgctggtcacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgtgggcagcgctgcccacgaagtggctgccacaatgatccgcctcggactcctgcctcactcatttacaccaaccaccacaactatctataaacctagccatggccatccccttatgagcgggcgcagtataggctttcgctctaagattacatatgcca

SEQ ID NO: 297639 - DNA, 908 bp, Homo sapiens
agccctgtccctgggggagttaaaggctcacagtcccactctgggacttccaaaagggatccaaccccaccctgcagggtccagtagaactgcggccccgcctggaaaatctgagccccaggatgaccaacgccccttctccgcctttacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgcta

SEQ ID NO: 297640 - DNA, 2287 bp, Homo sapiens
cgcccacgaagtgatgaaacacgcagaacctcctgctttgctgaactggcagcctatgagaagacggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttctgctttatctctctgtccaccatcggcctgggcgactacgtgcccggggaggcccctggccagccctaccgggccctctacaaggtgctggtcacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgctagacagtgctggagacatagttgggggtggagaactgcccttatggagcttgcagtccagtgaggtggacagacctgtccccagacagtgatggcccaaaatggtcaggactttaatggaggaggtgaggtgttgaaagcacaggcagagtggtcagggctgaagtcggagaagcatagggactaggcccaatccagcctggaaagtcagggaggacttcctagaggaagggacatcgaactaagacctgaactatgagaaataggcaggaagaagttgtacctgactcatttttctcaggtgtctccagggagcaggacccatggagggacccctggtgtaggcctgggcgatagactcttcctcagcagcctggcaggcaggaaacagacataggaccccagcccagatctgaatggcatgggaggtgctgcccttaaccatgacaccattgtaagagctgtccacatttgtatgttgtgccctggaatcagcctggttgagctcaaatcccaacttagccacgtctggcctgtgtccttgggcagtcacactacctctctgattttgtttccttatctgtaaaatggtgatcatcataatacaacttcaaaaggatttcaggctgagtgtggtggctcacgcctatacacccagcactttggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagtaaga

SEQ ID NO: 297641 - DNA, 525 bp, Homo sapiens
cgcccacgaagtgatgaaacacgcagaacctcctgctttgctgaactggcagcctatgagaagacggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttcgtgggcagcgctgcccacgaagtggctgccacaatgatccgcctcggactcctgcctcactcatttacaccaaccaccacaactatctataaacctagccatggccatccccttatgagcgggcgcagtataggctttcgctctaagattacatatgcca

SEQ ID NO: 297642 - DNA, 1118 bp, Homo sapiens
gttaatgttgtggaaggaagggaaacttcaggaaaggcttgctcacctcgctcggggccgcggaggtgcctggccacagtgccaccctcctgaccctgccgaggtactcggcagggcaccaccacgcatcccctcactggctgcagatcacatcagtttttcagtcagacttgttaatgtcaagggtccgtcacggtggtgataccactgtgtgacaggaagcgagagtcaacgcagggagcctgcaccctgcaaacagccacagcccttcactgaacggggagcataaatcccaccctagttagaaccatggcttttgtgcggaccagaagtgccagagccacaatataggggtgagatgtcttaccgttttgcggtgttgagtgtgtggattcccttttaagatagaaagtaggaaaactgccagtaagggagacgactcactaaaagaggattcagtctctggttgacatgttttgctgagtgtggttggttacttcaggtacagtatcacattaataggggccacagtctatatccctgtttagtttgttagttaccactcaagagcagacagatattgtccactttatcccaaatcccagccagactttgttgtatgctgtgcttcattcatggggctgtgaactactgattatattctccctattcctaatgtagaatgctttattctactgccatctttctgtctgcactgtttaattaggcttactgataacaactttaattctgaattttctttctcattcaggttctatttgtaattactaagacttaaagaatagtctggtgaaattactcaaagaattaaggaaggtttgagctaaaatgaactagagaccatctagtactttagtgtaaaatatgtttaatacaagtcgttaagtccttgtaagtgactattccaatgtttattctttgtttttggaagaatgcttggagttaccatgtttttaaatgtgaaatttcatctaaattaaaaaaaaaatctctgtgatgaggctgactcacccatttggtcaagattagtgctagctgatttgctgaacctttgcctacagaattaaagtactttctcaagttttaaaattggtgtc

SEQ ID NO: 297643 - DNA, 5493 bp, Homo sapiens
gtaagggcacccaccaggtgtaattgtgggcgagcggccgcttcggagctgacactaagcatgtgcagatcaagtccagaagcgccggggttcctcgaagcagttttcaggacttaaggctctgggacatccagcacagtgagcggcccctgggcaccaccagaaaacatttgtgggtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgagcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccatatactctttagcatctgtcttctgtcattcacattatgtatgtgagagtcatccatatgttgcatatagttgtagataattcattttcattgtcatgttgtatcccattctgtgaatatgctgcaatataatttatccattctactgtttgtagacatttgggttgtttgcagcttgggctattaggaattgtgttgctgtgtattggtgaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttttactatagccattagtggtgggcatatagtgatatgtcagttttagttttcggttttattttcttgtcctccaaaccattgtagtatctccccaggatagatgagtgatggctgagacctgagacctaggcctgttcctcacatgactgcaccattttacattctatcaatgtatgaggtttccggtttctccacatccttaccaactcttattattattagtcttttttattatagctatcctagtacatgtgaagttatattgtgatattaatttacactgccctaatgattaataatattgatcatcttttattgagaatctttgatgaagtgtctgtttaaatcttttgcccattatcagttgggttatttgggtttttttattgttgagcactgatagtttttaaaaatatattctgggtgtaacttcactatcagtccattatccttgcaaaggttttctcccagtctctggattgtcttttcattctcttaagagtgtcttttgaagaacagaactgcttattttgatgaagtccgttctttccatttgttcatttctgggttgtgctttgagtgctgtatctaagaaatccttgcctaaccaaagattacaatgattttttcctgtgttttcttctaaaggtttaagttttacatctagatctagcatgtattttgagttatatggtgtgaaatatggatccaagttcttttatgtttttgttttgttttgttttgtttttgcttatggatattcaaatgtttccacaccatttgtttaaaaatactaccctttctcaata

SEQ ID NO: 297644 - DNA, 5790 bp, Homo sapiens
ggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcgcatccagcacagtgagcggcccctgggcaccaccagaaaacatttgtgggtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggtgaggagggagaggaccccagaggcaagaattcattcagtgaagagataccctgacctgtccccagggcctaagggcagaagcagcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccatatactctttagcatctgtcttctgtcattcacattatgtatgtgagagtcatccatatgttgcatatagttgtagataattcattttcattgtcatgttgtatcccattctgtgaatatgctgcaatataatttatccattctactgtttgtagacatttgggttgtttgcagcttgggctattaggaattgtgttgctgtgtattggtgaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttttactatagccattagtggtgggcatatagtgatatgtcagttttagttttcggttttattttcttgtcctccaaaccattgtagtatctccccaggatagatgagtgatggctgagacctgagacctaggcctgttcctcacatgactgcaccattttacattctatcaatgtatgaggtttccggtttctccacatccttaccaactcttattattattagtcttttttattatagctatcctagtacatgtgaagttatattgtgatattaatttacactgccctaatgattaataatattgatcatcttttattgagaatctttgatgaagtgtctgtttaaatcttttgcccattatcagttgggttatttgggtttttttattgttgagcactgatagtttttaaaaatatattctgggtgtaacttcactatcagtccattatccttgcaaaggttttctcccagtctctggattgtcttttcattctcttaagagtgtcttttgaagaacagaactgcttattttgatgaagtccgttctttccatttgttcatttctgggttgtgctttgagtgctgtatctaagaaatccttgcctaaccaaagattacaatgattttttcctgtgttttcttctaaaggtttaagttttacatctagatctagcatgtattttgagttatatggtgtgaaatatggatccaagttcttttatgtttttgttttgttttgttttgtttttgcttatggatattcaaatgtttccacaccatttgtttaaaaatactaccctttctcaata

SEQ ID NO: 297645 - DNA, 5385 bp, Homo sapiens
gtaagggcacccaccaggtgtaattgtgggcgagcggccgcttcggagctgacactaagcatgtgcagatcaagtccagaagcgccggggttcctcgaagcagttttcaggacttaaggctctgggacatccagcacagtgagcggcccctgggcaccaccagaaaacatttgtgggtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgagcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccatatactctttagcatctgtcttctgtcattcacattatgtatgtgagagtcatccatatgttgcatatagttgtagataattcattttcattgtcatgttgtatcccattctgtgaatatgctgcaatataatttatccattctactgtttgtagacatttgggttgtttgcagcttgggctattaggaattgtgttgctgtgtattggtgaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttttactatagccattagtggtgggcatatagtgatatgtcagttttagttttcggttttattttcttgtcctccaaaccattgtagtatctccccaggatagatgagtgatggctgagacctgagacctaggcctgttcctcacatgactgcaccattttacattctatcaatgtatgaggtttccggtttctccacatccttaccaactcttattattattagtcttttttattatagctatcctagtacatgtgaagttatattgtgatattaatttacactgccctaatgattaataatattgatcatcttttattgagaatctttgatgaagtgtctgtttaaatcttttgcccattatcagttgggttatttgggtttttttattgttgagcactgatagtttttaaaaatatattctgggtgtaacttcactatcagtccattatccttgcaaaggttttctcccagtctctggattgtcttttcattctcttaagagtgtcttttgaagaacagaactgcttattttgatgaagtccgttctttccatttgttcatttctgggttgtgctttgagtgctgtatctaagaaatccttgcctaaccaaagattacaatgattttttcctgtgttttcttctaaaggtttaagttttacatctagatctagcatgtattttgagttatatggtgtgaaatatggatccaagttcttttatgtttttgttttgttttgttttgtttttgcttatggatattcaaatgtttccacaccatttgtttaaaaatactaccctttctcaata

SEQ ID NO: 297646 - DNA, 5822 bp, Homo sapiens
ggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcgcatccagcacagtgagcggcccctgggcaccaccagaaaacatttgtgggtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggtgaggagggagaggaccccagaggcaagaattcattcagtgaagagataccctgacctgtccccagggcctaagggcagaagcagtgctgaccatgctgccttgaacagcattgtgtcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccatatactctttagcatctgtcttctgtcattcacattatgtatgtgagagtcatccatatgttgcatatagttgtagataattcattttcattgtcatgttgtatcccattctgtgaatatgctgcaatataatttatccattctactgtttgtagacatttgggttgtttgcagcttgggctattaggaattgtgttgctgtgtattggtgaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttttactatagccattagtggtgggcatatagtgatatgtcagttttagttttcggttttattttcttgtcctccaaaccattgtagtatctccccaggatagatgagtgatggctgagacctgagacctaggcctgttcctcacatgactgcaccattttacattctatcaatgtatgaggtttccggtttctccacatccttaccaactcttattattattagtcttttttattatagctatcctagtacatgtgaagttatattgtgatattaatttacactgccctaatgattaataatattgatcatcttttattgagaatctttgatgaagtgtctgtttaaatcttttgcccattatcagttgggttatttgggtttttttattgttgagcactgatagtttttaaaaatatattctgggtgtaacttcactatcagtccattatccttgcaaaggttttctcccagtctctggattgtcttttcattctcttaagagtgtcttttgaagaacagaactgcttattttgatgaagtccgttctttccatttgttcatttctgggttgtgctttgagtgctgtatctaagaaatccttgcctaaccaaagattacaatgattttttcctgtgttttcttctaaaggtttaagttttacatctagatctagcatgtattttgagttatatggtgtgaaatatggatccaagttcttttatgtttttgttttgttttgttttgtttttgcttatggatattcaaatgtttccacaccatttgtttaaaaatactaccctttctcaata

SEQ ID NO: 297647 - DNA, 5736 bp, Homo sapiens
ggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcgcatccagcacagtgagcggcccctgggcaccaccagaaaacatttgtgggtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgagtgctgaccatgctgccttgaacagcattgtgtcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccatatactctttagcatctgtcttctgtcattcacattatgtatgtgagagtcatccatatgttgcatatagttgtagataattcattttcattgtcatgttgtatcccattctgtgaatatgctgcaatataatttatccattctactgtttgtagacatttgggttgtttgcagcttgggctattaggaattgtgttgctgtgtattggtgaacatatgtatgtattcctgttaggtatgtacctaagtgtatccatatgttcagctatatgttataaaaccagttttcaagtggttgtaccaatgtacactcccaccaacccagtatgcgagttctagtgctccacatacttgccaacatttggcattttccatcttttttactatagccattagtggtgggcatatagtgatatgtcagttttagttttcggttttattttcttgtcctccaaaccattgtagtatctccccaggatagatgagtgatggctgagacctgagacctaggcctgttcctcacatgactgcaccattttacattctatcaatgtatgaggtttccggtttctccacatccttaccaactcttattattattagtcttttttattatagctatcctagtacatgtgaagttatattgtgatattaatttacactgccctaatgattaataatattgatcatcttttattgagaatctttgatgaagtgtctgtttaaatcttttgcccattatcagttgggttatttgggtttttttattgttgagcactgatagtttttaaaaatatattctgggtgtaacttcactatcagtccattatccttgcaaaggttttctcccagtctctggattgtcttttcattctcttaagagtgtcttttgaagaacagaactgcttattttgatgaagtccgttctttccatttgttcatttctgggttgtgctttgagtgctgtatctaagaaatccttgcctaaccaaagattacaatgattttttcctgtgttttcttctaaaggtttaagttttacatctagatctagcatgtattttgagttatatggtgtgaaatatggatccaagttcttttatgtttttgttttgttttgttttgtttttgcttatggatattcaaatgtttccacaccatttgtttaaaaatactaccctttctcaata

SEQ ID NO: 297648 - DNA, 2043 bp, Homo sapiens
ctaaaaaagaaaaagcaaaaagaagatacttctcactaatgtaaagatggtaaagaagaaccatcatttactgagaacctagctgataatcggcacaaggctagatgttataaatatattaactccaaaacatatataatctgaggaaactccaaagcctccaagttttctatagcatcttcctgagaatacttcaaacttcacacttaaaaaaattcctccttcacaatgtccaaataatttaacattctgatctttatgacttcaaatgtgatactgaaatggtattcttggaaaatgattaagaatgagggaagactgggcatggtggcacatggctgtaatctcagctactcaggaggctgaggcaggagaattgcttgaacctgggggcgtaggttacagtgagccgagatggcgtcactgcactccagcctgggagacagagcaagactgtctcggggggaaaaaaatacaaaaagtagccaggtgtggtagcgcatgctgtaatcccagctacttggatggctgaggcataagaatcacaagtatgaaattgcgttgcaagaaagcagtgggcaagtcagaaagaagggagctgactgtgaggagacaaaggcttgctgtggattttataggatggtgttcgtgctgttttctggagagagctatgtgcagtactgataatgccaaggttgcagtgagctaatttgcatttttctatcagccgagggtctgatgatagctgggcgcaggaagattgtgacttatttacgcaggaggattatgtgtcctggaccatgaagaaaggcagacttacagcttatgtgctttctctttgcttttccttggtcccaccagcctgactccttttccctaattaggactccacatttaaaaatatattgttgattataatacagtgagtaattgtacctgtatttgtctggtgctcaccttgttcagaattgttttcctatgccatcttgttttatgggcaccatccagcagaggaaccagttttgttgctagaaattagtgattgatctggagcaaaacttgggttctgcccacgaggtttgccctatctattctaggcatggatggactgtccagggagtgccatattctgaggtaggtcagcagaaaaacaaaggtgtgacttcccctagtcggtaattacttatgtgctgaacacccaggtctgctaaatcagaatctccaggttttagcagaaaagctcctaagataattctgctgggcagttagaaaaaaaagaaggaaatgaaaaaggaaaagtgagaagacaaggaaagttaaccctgcattgtcttctgtggctagatggtcagcaagacagatggcctccagaatgagcaatgggccatcagcagacctgccggaagtagggttcagccacatgccatttatggcatggctgccctggtgttggtcaggggcttgattctttctgccagacaacaaaccagcccgtccactggctaacttagtgagaaggagctgtggacaccctggaccctgagggtggcgatcaggtcacccctgccctggagagatgtctatgtggggaagtgcccagaggagggaaggtgagcagctgctgcaggtggcccctaggcagtgtctgacaccacaccctgggggcttaaggaccttggctatttcctgtgttctgactgtattctgaataccaagagaatatttaccttttaaaaattgcttccatggctgggcgcggtggttcacgtctgtaatcccagcactttgggaggctgaggcgggtggatcacgaggtcaggagatcgagaccatcctggctaacatggtgaaaccccgtctctactaaaaaatacaaaaaaattagccgggcgtggtcgtgggcgcctgtagtcccagctactcgggaggctgaagcaggagaatggcgtgaacccaggaggcagagcttgcagtgagtcgagatcacgccactgcactccagcctgggcaacagagcgagactctgtctcaaaaaaaaaaaaa

SEQ ID NO: 297649 - DNA, 1748 bp, Homo sapiens
  misc_feature (1)..(1): n is a, c, g, or t
nctcttctccctgacatcttctcccctacaaaaaataaaataaagctgggtatgatggttcacacctatctataatcccagcactttgggaggccaatgtgggaggatccctttattccaggagtttgagagtggcctggacaacatagcaagatgtcatctctccaaaaataataataataaaaagtagccaggtgtggtagcgcatgctgtaatcccagctacttggatggctgaggcataagaatcacaagtatgaaattgcgttgcaagaaagcagtgggcaagtcagaaagaagggagctgactgtgaggagacaaaggcttgctgtggattttataggatggtgttcgtgctgttttctggagagagctatgtgcagtactgataatgccaaggttgcagtgagctaatttgcatttttctatcagccgagggtctgatgatagctgggcgcaggaagattgtgacttatttacgcaggaggattatgtgtcctggaccatgaagaaaggcagacttacagcttatgtgctttctctttgcttttccttggtcccaccagcctgactccttttccctaattaggactccacatttaaaaatatattgttgattataatacagtgagtaattgtacctgtatttgtctggtgctcaccttgttcagaattgttttcctatgccatcttgttttatgggcaccatccagcagaggaaccagttttgttgctagaaattagtgattgatctggagcaaaacttgggttctgcccacgaggtttgccctatctattctaggcatggatggactgtccagggagtgccatattctgaggtaggtcagcagaaaaacaaaggtgtgacttcccctagtcggtaattacttatgtgctgaacacccaggtctgctaaatcagaatctccaggttttagcagaaaagctcctaagataattctgctgggcagttagaaaaaaaagaaggaaatgaaaaaggaaaagtgagaagacaaggaaagttaaccctgcattgtcttctgtggctagatggtcagcaagacagatggcctccagaatgagcaatgggccatcagcagacctgccggaagtagggttcagccacatgccatttatggcatggctgccctggtgttggtcaggggcttgattctttctgccagacaacaaaccagcccgtccactggctaacttagtgagaaggagctgtggacaccctggaccctgagggtggcgatcaggtcacccctgccctggagagatgtctatgtggggaagtgcccagaggagggaaggtgagcagctgctgcaggtggcccctaggcagtgtctgacaccacaccctgggggcttaaggaccttggctatttcctgtgttctgactgtattctgaataccaagagaatatttaccttttaaaaattgcttccatggctgggcgcggtggttcacgtctgtaatcccagcactttgggaggctgaggcgggtggatcacgaggtcaggagatcgagaccatcctggctaacatggtgaaaccccgtctctactaaaaaatacaaaaaaattagccgggcgtggtcgtgggcgcctgtagtcccagctactcgggaggctgaagcaggagaatggcgtgaacccaggaggcagagcttgcagtgagtcgagatcacgccactgcactccagcctgggcaacagagcgagactctgtctcaaaaaaaaaaaaa

SEQ ID NO: 297650 - DNA, 1542 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagct

SEQ ID NO: 297651 - DNA, 645 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaagaagaatctagtctttgtgcagctaactaaagttagctgttggtcagagcagatctttgagaaatcacccattttaaatgcttgtttacatgttggtataatgttgcaaactgaccacaaattgcctctgatttatggtgtcgtg

SEQ ID NO: 297652 - DNA, 560 bp, Homo sapiens
gaactctagttcagagtgtgctatgcactgtgcctttttagagcctgttctaacctgagattggcagattcacctaaatattacgtgtttacatgtgtttttctggggaaaatgggtccatgatactctaagggagctaatgatgaaatcagattgaacagtgaaagtttcttttgaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagct

SEQ ID NO: 297653 - DNA, 455 bp, Homo sapiens
aaaacccataagtgaaaggtaacaggattgctttgccacgtaagttttactcctgccaatgagctaggacagtgctctgttctttatattccctgcctcataaaaatgtgaccatacttaaggaagaacttggcttcaatgtttttaggtcagattgtcaagcatggagatatcaagtgtgtactaaatgaaggcatgccaatttatcgtagaccatatgaaaagggtcgcctaatcatcgaatttaaggtaagctgtaatgtactttaagaatacttgagaacaattggcttactaaaatctgataaaaaagtaaaatttcagccaggtgcaagtagctcatgcctgtaatccccgcattttgagaggctgaggcaggaggatcccttgagccctggagttttgagaacagcctgggcaacatagtgaaaccctgtctctttaaaaaaaaaaaa

SEQ ID NO: 297654 - DNA, 2724 bp, Homo sapiens
  misc_feature (2384)..(2384): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297655 - DNA, 1921 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttgggcgataacattgatgttatccccacactgatttatcccccacggcgagaagtcgaattcagtcatccttttaatctccgaaatgctgtatgtatatacatagtgttgggcgataactaagg

SEQ ID NO: 297656 - DNA, 2666 bp, Homo sapiens
  misc_feature (2326)..(2326): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297657 - DNA, 2722 bp, Homo sapiens
  misc_feature (997)..(998): n is a, c, g, or t
  misc_feature (1002)..(1005): n is a, c, g, or t
  misc_feature (1009)..(1010): n is a, c, g, or t
  misc_feature (1013)..(1013): n is a, c, g, or t
  misc_feature (1015)..(1015): n is a, c, g, or t
  misc_feature (1052)..(1052): n is a, c, g, or t
  misc_feature (2382)..(2382): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgatgattaggcgacccttttcatatggtctacgataaattggcatgccttcatnnagtnnnnactnnatntntccatgcttgacaatctgacctggatgagaggtgatnacgatggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297658 - DNA, 2743 bp, Homo sapiens
  misc_feature (2403)..(2403): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccgttgcattttcttatttcaggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297659 - DNA, 2825 bp, Homo sapiens
  misc_feature (2485)..(2485): n is a, c, g, or t
ctttacgccaggtaccagataatcagtccatgaaattcaaaaacacacattcttctctaattcccacatgagagatcactgaactgggtaaaagcaacaaaacaggaattctatgggtggggttgaaacaatccctaggaaaaaatgcaaatctttcagactgatccatgattcctttatcatcatatacggctagttttatccagtgggagaaagcagatgcggtaaaagcttaagcttttaccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297660 - DNA, 1578 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctaaaaaaaaaaaaccccccttccccgccatttttggg

SEQ ID NO: 297661 - DNA, 1740 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctaaaaaaaaaaaaaaaaaaaaaaaaaaaaaaaaacgcgggggctttttgtgtggggggggggaaaagggggtttgaaaggggcgcctggggccttagtgttgttccctggccccagtttttttggcccacagggggaaatccgggcggggcccccctaaaaagggggccggttaaattcggaaaccggggtacccggta

SEQ ID NO: 297662 - DNA, 2529 bp, Homo sapiens
  misc_feature (2189)..(2189): n is a, c, g, or t
gtttttctcaagtgactttgaaggtaatgcttttgcttaccatatttccaagatggccacgtctgtgcccttaagcaaatatttaatctctgacctgattttccctcatctgtgattacatcacagtttgaggatcatctgtgataacgtgaacattctgtgtatatagtaggtagtcaacagatgtaccctgtgaggctcatcttttattattctttgccacattctttatagtgcctttagcacaaataagatccagcatcttaaacagatttgcaatgaggaaatattttgttttagggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297663 - DNA, 2535 bp, Homo sapiens
  misc_feature (2195)..(2195): n is a, c, g, or t
ggttgaaagcccgaggggctactcgaggaagaatcgagaccgggcttagtaggaacacgggtgttggaatgtactcgagtgctcgtgattagaaaacctcgacagatgaatggaggtagcaggaatgggtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297664 - DNA, 2798 bp, Homo sapiens
  misc_feature (2458)..(2458): n is a, c, g, or t
ggtactaccggtgcgacagtgggctcttccgctcctcacacacggctcagccgacgcagtagaagatggtgaaagaaacaacttactacgatgttttgggggtcaaacccaatgctactcaggaagaattgaaaaaggcttataggaaactggctttgaagtaccatcctgataagaacccaaatgaaggagagaaggtgaatagtatctactcttaaacgtatctgaatagttctttgccagacgtatagtatttctattatggcctgaaatcgagtatctaatatagtaactatgatcacttctcggcctttttagctaagatcaagtgtaatgtagctaggtaacacttgttttttaaaaaatgaaattcactcctcttttctcaaacatttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297665 - DNA, 2473 bp, Homo sapiens
  misc_feature (2133)..(2133): n is a, c, g, or t
cggccgccccaacatcagaatggtacttcaaggccagtttcctataagaacccaaatgaaggagagatttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297666 - DNA, 2670 bp, Homo sapiens
  misc_feature (2330)..(2330): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagagtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297667 - DNA, 2546 bp, Homo sapiens
  misc_feature (2206)..(2206): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297668 - DNA, 1786 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgacgtcacgaattactcgtacacacgagatgtgctaggattcaagagatgtttacaagctctccaggaccaagtagtggattggatggggactgcgctaaagacaatcaaggtgttgagagatgacttcatggcattatgccttccagaaccagatgggcgatgatcctctgtactaagaaacaaatggctgggggacacccagtttaaaagggaaggttctggatctctgggggataggttcaggcatgcccaagcctgaaccatgtcaccatcagcgcaaagccacagctatgagggggagatggtggtgataaaacagacagagtgat

SEQ ID NO: 297669 - DNA, 1484 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtttaataaactatagtagtgttttaaaaagttaaatgaagaataaacgcaaatataaaagct

SEQ ID NO: 297670 - DNA, 1954 bp, Homo sapiens
  misc_feature (1614)..(1614): n is a, c, g, or t
actctagaggaccactaaatggtgtaggtgccagacaccgttcactgtgcaaggaaatggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297671 - DNA, 1367 bp, Homo sapiens
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaagctgtaatgtactttaagaatacttgagaacaattggcttactaaaatctgataaaaaagtaaaatttcagccaggtgcaagtagctcatgcctgtaatccccgcattttgagaggctgaggcaggaggatcccttgagccctggagttttgagaacagcctgggcaacatagtgaaaccctgtctctttaaaaaaaaaaaa

SEQ ID NO: 297672 - DNA, 1540 bp, Homo sapiens
  misc_feature (997)..(998): n is a, c, g, or t
  misc_feature (1002)..(1005): n is a, c, g, or t
  misc_feature (1009)..(1010): n is a, c, g, or t
  misc_feature (1013)..(1013): n is a, c, g, or t
  misc_feature (1015)..(1015): n is a, c, g, or t
  misc_feature (1052)..(1052): n is a, c, g, or t
agcggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgatgattaggcgacccttttcatatggtctacgataaattggcatgccttcatnnagtnnnnactnnatntntccatgcttgacaatctgacctggatgagaggtgatnacgatggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagct

SEQ ID NO: 297673 - DNA, 1742 bp, Homo sapiens
  misc_feature (1402)..(1402): n is a, c, g, or t
gaactctagttcagagtgtgctatgcactgtgcctttttagagcctgttctaacctgagattggcagattcacctaaatattacgtgtttacatgtgtttttctggggaaaatgggtccatgatactctaagggagctaatgatgaaatcagattgaacagtgaaagtttcttttgaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccanaaaaaaaaaaacaaaaataaccaatacacactaaaaaaaccggggggggacccgcctacaacataaccccgggagggcgcaccccgaagctagagcgacgagccagatggtcctctgaccaaacggccccactgagtcgagctgaataacataccgagcacggccaactgtacaccagagctgcacggacaaacgtgacccggaccactgtggaacgaacaccaatcggcggagccaccatgaggccacgtacaccagccatttaccccacacgcaactaaacactgcagcgatcggtccacacggcagacgccactaacccgcccacctgcagaataca

SEQ ID NO: 297674 - DNA, 241 bp, Homo sapiens
attcgtgatttgaaaaatataaatatgtgtcatattttatgcagacgaggagaagaccttttcatgtgtatggacatacagctcgttgaagcactgtgtggcttccagaagccaatatctactcttgacaaccgaaccatcgtcatcacctctcatccaggtatgggaactaggcaagcttaaacttctcttttctattctagtattttccttgtctcctgttaacaaagtgtagtatagg

SEQ ID NO: 297675 - DNA, 998 bp, Homo sapiens
tcaattggaggaacaggcctggaaaagaataatgagattgaagagggtcagtttgaggactcaggttggggcaggtttggattaagttaggaaaaggatctgggagggactctgttcagtgtaggtcaactgagcattatgtagcccaaagataaatttaaaccctgcttcaagcttacaatctagtggggaggcagacccatacctaattaactgattcaaggcatgatgagtaaactttaagatgattacagaaagaggggagattaagtccatttgaaagcatccagggagcctctgaggagacagcatttgaacttgctctaatgaatgggttcactaggtggaggtggatggaaaggttccataggcgaataacacgtcttgagcgagcctgacaagtcagaaaatgcagtatgttctgggaaaggagcgtcctgagggagaagaagcacaggtgtgagggaacatgtgatgaagaaaggaccacagaaagtcaaggtcagagattggactgcatcctgtgggcagtggtccaggtgacgatgaaaaagagggagaacaggtgagtgctgcagtacagacaaggagtaagaaaacggccatcatcttgtgaattaatacctactgtgtgttaaccagcccttttcctaacaccacaaatcctctcaacgtctgtccaaaaggtgggtggtggtggccaggcacctcactcctgtaatcacagcactttgggaggccaaggtgggagcactttgggaggatcacttgaggccaggagttcgagaccagcctggccaacatggtgaaaccccgtctctactaaaaatataaaaactagctgggtgtggtcttgggcacctgtaatcccagctactcaggtgtctgaggcacaagaatcacttgaacccgggaggcagaggttgcagtgagctgagatcatgcctctgctcttcaagtctgggtgacagagcaggactctggttccaaaaaaaaaa

SEQ ID NO: 297676 - DNA, 2775 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaattt

SEQ ID NO: 297677 - DNA, 903 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaatgtggggaagggggccatgtccattctattggtggcgctctgggcaaattgggcccaggtttttgggcatgaactaccaggttgatcaaggtttatac

SEQ ID NO: 297678 - DNA, 802 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtgagttttttatttgcctctcctggacttggatgatgaatgggcacatttatggactgggacaggggttgatggcagtccctgagacataagggatgaaatgatgtgtccaaagtcaacacatttttcagcccccttccctgcaacccaagagacaatttggcatccctgtatgggtttcctccccggtgctgtccctcatgtgagctgggtctaggccactgagtcatagcatctattctctgggatgggaccctcggagacagctgtgccttgtgttctcgccccctgtgcttctgctcaaggagtctccctcttgaatgccttcactctccccattgcctcc

SEQ ID NO: 297679 - DNA, 447 bp, Homo sapiens
cactctagaggatctcggcggatggggtctgtagaacgtgcctggcaattgcggggatcacccgcctcatcctcccaaaatgctgggattacaggcgtgagccactgtgcccggcccaggctgtggtttttaacctgtgaaagtttgtccagcttcctcagttttaggttttgtttgcaggtagccactccagtcctgactttattatttttcactctttcctagaacccacgagaagctgatcccatgactaaagtgcaggccgaactagatgagaccaaaatcattctggtaagcaggaagatggagagcaagcccaagaactgaggcgggggtgcgatttccactggccaggcatgcacagatccatcctcgttttaatataatagtaaccacggcactctccagcaagtgggattgcccaccccttcccccaccccgggcatc

SEQ ID NO: 297680 - DNA, 232 bp, Homo sapiens
tctggggatgttaatttctgggatgcggttggggttggggggtgcggtgtgggtcactctccaacccagtacaatcatatagtgcccagctactcttttttccaaagctccatgcacacgcacatgtgcgtgcacacacacacacacacacaaatgtatatataaatgtgtgtgtatatatatatatgagttttcctggagtgctggttatctaagcctgtgctggggacag

SEQ ID NO: 297681 - DNA, 3067 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297682 - DNA, 3120 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttgaacacaagaaaggacaaaaagagaacaaaaaaaacaaagttgggggggggcttgggcccccgcgaaaaaaacgtgttcgcagaacaagtcggctgtggggggcggcgggccccaacgagaggcaaagggtcgaccactgtggcccacaggcgggcgccccaaagaggaaaccccgtggcgaaccaggaacacaagggccggggggaataccagaccacaaattaaaaacaccgccggggcggcaccacgaccgcgtccggaaagcacccaagaaggaaggcagaggggcagacaacgggacacaccacacaggaggccaaggcggagcgtcagaaacaatagcg

SEQ ID NO: 297683 - DNA, 3036 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297684 - DNA, 3118 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactaaaatatttaattgacaaggatgggtgctgctgactgccgctttctctcaggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297685 - DNA, 2609 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagccaggccttgaggcgatcagctgccctgtgcgacgggtgatgggctgtcgaggtgctactccccttcctgggctggggattgggcggaatgcgttaattgggaaaggagtgattcgttgggtccgctgggggtgttttcgcgtttggcggccccctctcccttttttgtttgggtttggccctcttgggtttgttacattcggggttcttttctcttg

SEQ ID NO: 297686 - DNA, 2514 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctcgcccccatctctccccagggtcctcaagtgggaaagggagaggtagcatccctcggatccaggcccactccactccgtctccggcaccagtgggcaggctgagtctgggcctcaaggggccctgggcttagggtatctatgg

SEQ ID NO: 297687 - DNA, 2780 bp, Homo sapiens
ggctaggctacgaggtcgtgcgtgttttacttcggccgaggctagaggcttctggtcataggatctagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297688 - DNA, 3208 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctggttctgttccatccacttggacagtaactattcttggaccgagtctcgacacctagaggtgaagtttgtgtgtgttggagaggaacccagcacaacaccatggagtctctgttagagcgaggtgagaagctagatgacttggtgtccaaatccgaggtgctgggaacacagtctaaagccttctataaaactaaaatatttaattgacaaggatgggtgctgctgactgccgctttctctcaggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297689 - DNA, 2965 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297690 - DNA, 2273 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgaggggtgtctcagcaaagaccgggctaaactgccgggtttgtcacacactgc

SEQ ID NO: 297691 - DNA, 2228 bp, Homo sapiens
  misc_feature (2120)..(2120): n is a, c, g, or t
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatgggtcccttggtttgacccttgnttggcctgcagcccgtgtcggtgcccttgttgagccctgtctaccaactcgggctcgcccatgcgcggtccgggggttccgttagacccccggtctctgcccctgccg

SEQ ID NO: 297692 - DNA, 1863 bp, Homo sapiens
tattcatgaccgggcctggcgttctcctgttagtcctgtccgttggtgtacagtagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297693 - DNA, 1875 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcaaggcagtcttagagccacagagtcaaataaaaatcaattttgagagaccacagcacct

SEQ ID NO: 297694 - DNA, 1818 bp, Homo sapiens
ccaagacgggtggcgcctacggcgaggacctgggctccggacctacaagcctctcccaggtatgcgacgggaataggtatccgtccacgtcatcgagggtgaccaccgcacgctgttggagggcagcggcctggagtccatcatcgagcatcatccacagctccctggctgagccacgcgtgagcgtgcgggagggctaggcccgtgctgccctgctgcgcgagtgtccgtgtccacgattccgaaccaacaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297695 - DNA, 2076 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297696 - DNA, 1962 bp, Homo sapiens
atcatggctaagatctgctactgggcgcactgtagtatgctgtcgaaggtgagcccaacataaagggtacccggcatgtctcgtcttcagggccaccgtattagtggacggtcggtataatagtctatggggtcgcgcgcagtccgtgatgactgtcggttcgtagaccttgacgcatattaacttgctaggctttgggcattctctcggtagaagggacacgcgttacctatctttagggtgtggatactaattcgcgcaacaaacatggtcggcatagtaggatatggatgcgcgtaaaggtcatagtattagagtgggctggagaggatggtgattgaagggttgtgtggagtactgaactggataatggtcattagttagcgtaagtagagtctcagcgtataagtgggggttagtgattccatgatgttattatgattgcgtacaggtaggcgtgagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297697 - DNA, 1469 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccaaatatctcatcaacaaccgaataaacaaccacccaaaaatgactaatcaaactaaactccaaaccaaatgataaccatacacaaaactaaaggacgaacctgatctctatatactaagtatccttaatcattctattgccaagaactaactcctcggactcctgcctcatcattaaacaaacaacccaatatctaataaccctagccatggccatcccttatgagcgggcgcagcactacaggcttcggccctaaaattaaaatgcctagccaattctttacacaggcaaactaacccttattccaatc

SEQ ID NO: 297698 - DNA, 946 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccaggctttatggctgaacaccacgcgagacacggaagggcgatgccaggcacagaacgtctgtaaaa

SEQ ID NO: 297699 - DNA, 783 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctggtaagcaggaagatggagagcaagcccaagaactgaggcgggggtgcgatttccactggccaggcatgcacagatccatcctcgttttaatataatagtaaccacggcactctccagcaagtgggattgcccaccccttcccccaccccgggcatc

SEQ ID NO: 297700 - DNA, 921 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgtcctgttgtgttctgttgtaaatcatttggcgagactgtattttagtaactgctgcctaacttccctgtgttctatttgagaggcgcctgtctggataaagttgtcttgaaatttacaaaaaaaaaaaaaaaaaaaaaaaaaaaaaaaaaaaaaaaaaaaaaaaacagcgggggattattatatgggggggggaaaaaaggggttataaagggggccaagtgggtccaataggggttttaccataggaccccatatttttttctgcgcaccaaggggagtaatatcgcgagggttccccaatataaggggcgcagcgacataaattgacgataaccacggggtaccgcgcgatttatgtccgcagaaaactgtagatacacaatacaaaggacacgacacagggaga

SEQ ID NO: 297701 - DNA, 498 bp, Homo sapiens
atataaatgtgtgtgtatatatatatatgagttttcctggagtgctggttatctaagcctgtgctggggacagctttttgggaagtctgctacatcccagttagatcttctagatttcacgggaatgtcaccaggttctgttccatccacttggacagtaactattcttggaccgagtctcgacacctagaggtgaagtttgtgtgtgttggagaggaacccaggtaaggcactttcccccatgactgaaatatgaggggctcatgtcagggcacgtactgaacagagctggattctcttttcttttttgtccagcacaacaccatggagtctctgttagagcgaggtgagaagctagatgacttggtgtccaaatccgaggtgctgggaacacagtctaaagccttctataaaactgtgagtacccagcacctgctgcctcctgggtgttctctctagagagcagtcgcagcttgctgcttctggcactctccacta

SEQ ID NO: 297702 - DNA, 4512 bp, Homo sapiens
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttcta

SEQ ID NO: 297703 - DNA, 4900 bp, Homo sapiens
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttctaatagttcttcctgcattcgaatggatcctcaccacccacaactgctgcctccaacatgcccattttctaggactgttcaaattcaggactggtgacatgcaataagtggtttgcgccacctggtggtcctgggaagtggcctcgggctcagggacttctgggggttgccccttgaggacggtgtctcttgcgccttcatcctctcattcaatgagggccaactgtgtgctgcacgctgggcggggtgatggggatacggtggtgggaggaagtttggctgcctgtcctcgtggggctcacagtttcgtgaggagaagaacaggcagttaccattaccacttgggcctctgggaggggctggaaagagaagccaaaaaatgacctggaa

SEQ ID NO: 297704 - DNA, 1704 bp, Homo sapiens
  misc_feature (2)..(2): n is a, c, g, or t
  misc_feature (5)..(7): n is a, c, g, or t
gncannngggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaaaagaacttggagaaaggactgggcgtggacagtgtggacaaggatgccatgaacgcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctttattcctgatatagaatatctttcagatattaagggactgattaaatacttgggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggagtagctatccagatcacaaggaaggggaggaccccaataaggctgaggagttgccctcagaaaagaacttggaatatgatgatgaaaccatggaattgattctgccttctggtgccagagtgggtcatcgctccttgatgagatactacaaacagcgatttggcttgtcaagagctgtggcagttgccaaaaatcggaaggccgtgggccgagtacttcagcagtacagagccctgggatggactggcagcacaggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccata

SEQ ID NO: 297705 - DNA, 1416 bp, Homo sapiens
tataagcttctgtttcctcatttataaaacagagatgatagtaataagacctacctcttagagttgagtgggttgaatgtcatgcatgtgtgatatagtgcatgcccatagtcgaggttagctatcagtccccttttttgtaattttcccatagaaaatttagcaaaagttagaagagtaaagcatgccactgcaattgttgagttttgaaacctcatcagtatggtactctttacatctattctgatgtgtcttctggatgaagctggttatatccttagatcttcagggaaagcatctatccaactgaggactgtggagaaaataagaggcgggctgccttctgatggcctgggaagctctaggcaactaaaatccatttgaaaaggcactgtgtttatatgtggtttccttcactgtggctgcttgtgagctgtgtggccacttgaatctggcagagacttgacttcatcttactcttatcaggaagtattgtctgactcgatatatagcttctgcctttctgattaatggggctttaccttttgggcttataaactcttccagatgatgaaaactaaagctactaatcccagataagtgtatatatacaaaagttctggtatgcaattctggagtccacagagacccctgaggcgcatggcttagagaccccaagttagcaactctgttttaaatacaagaacctagttaccccaaactaaccttttgaattctctgccaaggttggattttctctgatcacaaataacagaactttgcctaatttcttaactgccttccaatcataggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccataaaacccaaatgtacatgaataaaccagaccaatgtcccacactactgggtactgacactcgccttcaatatgtccgatcttcagactctgcttctttcttatcaacacattcgaacctgctgattccactatgtggatctgaagtgcatgaacagatattgcaggattttaacaaagctgttaaacataattacatatccagaacaagagttaggatcatgctatgattttactctagaatggaaaagacatggacttatatgtttattggcaaaccggagctgatcacataaattgtcccgacattacaagacctaaagtgacaacctagcatacaa

SEQ ID NO: 297706 - DNA, 1951 bp, Homo sapiens
  misc_feature (2)..(2): n is a, c, g, or t
  misc_feature (5)..(7): n is a, c, g, or t
gncannngggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaaaagaacttggagaaaggactgggcgtggacagtgtggacaaggatgccatgaacgcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctttattcctgatatagaatatctttcagatattaagggactgattaaatacttgggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggagtagctatccagatcacaaggaaggggaggaccccaataaggctgaggagttgccctcagaaaagaacttggaatatgatgatgaaaccatggaattgattctgccttctggtgccagagtgggtcatcgctccttgatgagatactacaaacagcgatttggcttgtcaagagctgtggcagttgccaaaaatcggaaggccgtgggccgagtacttcagcagtacagagccctgggatggactggcagcacaggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccatatgagttttcagatgtcgtttttgaatagtgttgaaaggttatgttttcacaaggtaagtcctgtgtctactggaccctgggacttgcactgctgcctgacagttgcttcatcgcctcagctttaaatgatttatgattgtcagagtaatgtgaggaatcaggaatgacttgtgtgccccaaacttagtttaactttcagagtaactcaccatgtcatggcactgggacctatgtaagggggcttgaa

SEQ ID NO: 297707 - DNA, 1650 bp, Homo sapiens
  misc_feature (2)..(2): n is a, c, g, or t
  misc_feature (5)..(7): n is a, c, g, or t
gncannngggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaagcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctttattcctgatatagaatatctttcagatattaagggactgattaaatacttgggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggagtagctatccagatcacaaggaaggggaggaccccaataaggctgaggagttgccctcagaaaagaacttggaatatgatgatgaaaccatggaattgattctgccttctggtgccagagtgggtcatcgctccttgatgagatactacaaacagcgatttggcttgtcaagagctgtggcagttgccaaaaatcggaaggccgtgggccgagtacttcagcagtacagagccctgggatggactggcagcacaggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccata

SEQ ID NO: 297708 - DNA, 999 bp, Homo sapiens
  misc_feature (2)..(2): n is a, c, g, or t
  misc_feature (5)..(7): n is a, c, g, or t
gncannngggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaaaagaacttggagaaaggactgggcgtggacagtgtggacaaggatgccatgaacgcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctcatccttaggaggggggtcctgctagatcgatcat

SEQ ID NO: 297709 - DNA, 794 bp, Homo sapiens
  misc_feature (2)..(2): n is a, c, g, or t
  misc_feature (5)..(7): n is a, c, g, or t
gncannngggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcattaatgaatcggaagagagaaagagcgagggaaagagacgtgaagaaaaaaggaacagaagggaagaaaggacgacacggacccgccacaacaacaagaccgagacaagacgcgaaacacacacaggaacagacaaaacacaccagcatacaaaaacaagaacaacaacaacaagagcaaaaaacgaaaaaaaaaaaaaacaaaagaacaaacacaaacgcaaagagaaaagaagaacgagaaaagacaaagaagacagaaaaagaaagaaaagaagagaagacacgaaagaaaacagagaaagagagagagaggcagaacgaagacgaaaggagcgaacaaagaccataagaggcaagacgagacgagagagaaaaaaaggagagagaaacagagcgaaaaggaagagaaggagcgaagaagaaacaaaaaaaaagaaataagagagagaggacaaacagagaagaaggaagaggaaaaaaacgagagcagaagaagagagaacagaaagaggaagagaaaaaggcagacagaaaggaggagggagaaaagaaacgaaaacaaaaaggaaggaggaagaaaagaaaggaaagcaagacgcgagaggaggaaggagaagcaaacggaaggagaaaaagggacg

SEQ ID NO: 297710 - DNA, 4180 bp, Homo sapiens
gcggggaagcagcagcggccaggatgaatcccaggtgctctggagctggatggtgaaggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297711 - DNA, 676 bp, Homo sapiens
accggtgaggcgacagggaccgcttcgtcactcctcgatgccagaagtggtaatagtccccgaagatctggcccaggttgaggaacccatgcttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297712 - DNA, 4352 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297713 - DNA, 3704 bp, Homo sapiens
accggtgaggcgacagggaccgcttcgtcactcctcgatgccagaagtggtaatagtccccgaagatctggcccaggttgaggaacccatgcttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297714 - DNA, 3480 bp, Homo sapiens
tgccggtgttaagggccccctcaaggtccccggtatcgtataagcttgattagccggacccccagcctcggtacacacagataaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297715 - DNA, 4508 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccagaaaaaaaaaaaaattcagaggaatcataggcgggggcgcgaaaaaagacggtactagaaggggccatgggccaacgggtacccgagaccaaggttttggccacggggaaaccgcggtccccaaatggaccggatactcaaaaggccggaccgctag

SEQ ID NO: 297716 - DNA, 3007 bp, Homo sapiens
agcactctctgtagggcagcccttagggcagctggagagctgctcccaaaaaagactgatccccagcctctcccttccttctttgcagtaagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaagtgagggctggacccaggctgggagggggccagtgggacctgagagtcgcagggggtgcccgctggtccctctgggccaggctgaccatcatggtgctctcctgcacagagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297717 - DNA, 4283 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagattccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297718 - DNA, 4331 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttccatggttatagacgtcccgaccatgtaagacggtattccagtaatt

SEQ ID NO: 297719 - DNA, 3979 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaa

SEQ ID NO: 297720 - DNA, 3638 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgtttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297721 - DNA, 1986 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297722 - DNA, 1003 bp, Homo sapiens
aatggctagtatgaggctggtggttaattcgccgaggcatgctggtgccaggctagccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccag

SEQ ID NO: 297723 - DNA, 2434 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggctcatccctggaacagaagagctgtgtacagcagtggacatccaggctaacggaccacccaagagtactcgaatacggcactaatagacaacgaaagaatgaaagatggaggaacccatccggggcacagcggatatagagcaccacatgagacgccttcatgtgccaccatgcccaggggacgggccctgaagagaactgaccacaagatgacccgaagacaaggcctacctggaaccag

SEQ ID NO: 297724 - DNA, 2302 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggctttgacgcaggcgc

SEQ ID NO: 297725 - DNA, 1519 bp, Homo sapiens
ctgcccccgcccgcgccggagctggagcccaggccgagccctgccctggtcgccggccgggccgaggccgcgccgccgcgcctccccgcctccgcgccgtgacgctgccgccgggcgcggggaccgcgccgagcccaggcccccgccgccgggctctccgctcggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagaagcagcaccacgaattcgccgagcagcaccacgaattcgccgagcagcaccacgaattcgccgagcagcaccacgaattcgccgagcagaaccacgaattcgccg

SEQ ID NO: 297726 - DNA, 4517 bp, Homo sapiens
  misc_feature (24)..(24): n is a, c, g, or t
  misc_feature (28)..(29): n is a, c, g, or t
gtagtttcgagcccgctgcccttngccnnctgggcggagaagctgcttcctcctgggaacaaccgcctcccgctcctagcaggttgctactgccccgaacccgcgctgcagggaacagcggggcaaacagtgagtggggttcagcgtagactctggaccaggagaggcccgcggtgaccgaggcctgggccccggaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaagattgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttatggaaaatttttg

SEQ ID NO: 297727 - DNA, 4477 bp, Homo sapiens
  misc_feature (24)..(24): n is a, c, g, or t
  misc_feature (28)..(29): n is a, c, g, or t
gtagtttcgagcccgctgcccttngccnnctgggcggagaagctgcttcctcctgggaacaaccgcctcccgctcctagcaggttgctactgccccgaacccgcgctgcagggaacagcggggcaaacaaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaagattgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgtaaggagtgcccatcgaggtggcaggccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttatggaaaatttttg

SEQ ID NO: 297728 - DNA, 3462 bp, Homo sapiens
  misc_feature (24)..(24): n is a, c, g, or t
  misc_feature (28)..(29): n is a, c, g, or t
gtagtttcgagcccgctgcccttngccnnctgggcggagaagctgcttcctcctgggaacaaccgcctcccgctcctagcaggttgctactgccccgaacccgcgctgcagggaacagcggggcaaacaaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaagattgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgtaaggagtgcccatcgaggtggcaggccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttctggtatgtgcctggtgtcgttaacggattgaacggctgttgcgaagaaaaagagtggggcccaaaaaattcctctaggggataatggcccacccgacgcaaaattcaaggcagggaaccctaaacaggcgggccgtaaaacgccaaacgcccgtcacgggaacccccggaaagcaccattgccaggaggggaccccgcggcgacacc

SEQ ID NO: 297729 - DNA, 1904 bp, Homo sapiens
catcagccagatcttttaggttctgcattactcaaatttcagttattctttctagggtaccatgaaagtgttctctagtttgttggattttgaatgatggactatttcagtgaagtgcctgactcccagagatcccaaacactgcatgttctcagagaggaaattagatcctccatctttgagaatatgtgtatccatccttgccctctttaatatatttttagcagtacatcccggggatatatttaaaatataaagttatccatgttacttccgtgtctaaaagcctccactggaatttctaatttgagataatggagtaaacataagtttaccttccctccctccccaggccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttatggaaaatttttg

SEQ ID NO: 297730 - DNA, 3252 bp, Homo sapiens
ctccattggatgggagttcagcagtgtgtttaagactagggtcatgcccacatcaatctcagattcccattttatctttcttttttggtatcactcctagtaccaagtcttgtgtctgtcaatatcctgtccaaaaaagaaaaacacaccaaggaaaattaatataggaaaaatttaaaaagttattagaggactgaaaatataaaaatggaacactgaaagacacagagtttttattttcagcactgcagctctgatggtccagctccaccaggacacagatccccagatccctaaaggtcagccatgcaccctgaacagctcagagggaggagccagaccagcagtgcctcacaccttgttctcttctgctctagacagatggctccataatgacagcttcataatggcagtgggtgagcccctggtgcacatcagggtcactcttctgctgctctggtttgggatgtttttgtctatttctggccactctcaggccaggccctcccagtatttcacttctccagaagtggtgatccctttgaaggtgatcagcaggggcagaggtgcaaaggctcctggatggctctcctatagcctgcggtttgggggacagagatacattgtccacatgagggtaaataagctgttgtttgctgcacaccttcctgtgttcacctacacagagcagcatgccctgctccaggatcagcccttcatccaggatgactgctactaccatggttatgtggagggggtccctgagtccttggttgcccttagtacctgttctgggggctttcttggaatgctacagataaatgaccttgtttatgaaatcaagccaattagtgtttctgccacatttgaacacctagtatataagatagacagtgatgatacacagtttccacctatgagatgtgggttaacagaagagaaaatagcacaccagatggagttgcaattgtcatataatttcactctgaagcaaagttcttttgtgggctggtggacccatcagcggtttgttgagctggtagtggtcgtggataatattagatatcttttctctcaaagtaatgcaacaacagtgcagcatgaagtatttaacgttgtcaatatagtggattccttctatcatcctttggaggttgatgtaattttgactggaattgatatatggactgcatcaaatccacttcctaccagtggagacctagataatgttttagaggacttttctatttggaagaattataaccttaataatcgactacaacatgatgttgcacatcttttcataaaagacacacaaggcatgaagcttggtgttgcctatgttaaaggaatatgccagaatccttttaatactggagttgatgtttttgaagacaacaggttggtcgtttttgcaattactttgggccacgagcttggtcataatttgggtatgcaacatgacacccagtggtgtgtgtgcgagctacagtggtgcataatgcatgcctatagaaaggtgacaactaaatttagcaactgcagttatgcccaatattgggacagtactatcagtagtggattatgtattcaaccgcctccatatccagggaatatatttagactgaagtactgtgggaatctagtggttgaagaaggggaggaatgtgactgtggaaccatacggcagtgtgcaaaagatccctgttgtctgttaaactgtactctacatcctggggctgcttgtgcttttggaatatgttgcaaagactgcaaatttctgccatcaggaactttatgtagacaacaagttggtgaatgtgaccttccagagtggtgcaatgggacatcccatcaatgcccagatgatgtgtatgtgcaggacgggatctcctgtaatgtgaatgccttctgctatgaaaagacgtgtaataaccatgatatacaatgtaaagagatttttggccaagatgcaaggagtgcatctcagagttgctaccaagaaatcaacacccaaggaaaccgtttcggtcactgtggtattgtaggcacaacatatgtaaaatgttggacccctgatatcatgtgtgggagggttcagtgtgaaaatgtgggagtaattcccaatctgatagagcattctacagtgcagcagtttcacctcaatgacaccacttgctggggcactgattatcatttagggatggctatacctgatattggtgaggtgaaagatggcacagtatgtggtccagaaaagatctgcatccgtaagaagtgtgccagtatggttcatctgtcacaagcctgtcagcctaagacctgcaacatgaggggaatctgcaacaacaaacaacactgtcactgcaaccatgaatgggcacccccatactgcaaggacaaaggctatggaggtagtgctgatagtggcccacctcctaagaacaacatggaaggattaaatgtgatgggaaagttgcgttacctgtcactattgtgccttcttcctttggttgcttttttattattttgcttacatgtgctttttaagaaacgcacaaaaagtaaagaagatgaagaaggataagagaaatgggaaaaagaaggagactaaactttatacttcatttttaatatccaattttttaatagaaaaatatgaagccatgtctcactgtttaaataaaacttcatggacatttcatgtcaggattgcaagcattagctatcacagcaaaggattcctagcctattcttacttactctacagtgtcttaagcaatattaaaggttccttttcccagaagttgtgtctttatgtttcctgagcaaaggcacagaaaagatagtttcaagctgttgtccctcatttttaactctcctctctctctctctctttttttttttttttttgctgtactatgtaatgttcaggatgtgcctgtacacaactcatttctgtttggcacattcagctgtgccaaagggggcagtagaagtagcctggagtgatgatgagggaagaagggagctttctttcctgtgtgcttaccatgagtgtcaccattattttggttggggccattcactctggcaattatatttggtttcagattccagttctgttgtcacttttagaaccaccctcatttttccttagaaataccagcagcagttggacactgacctccttaggggtccgggagtgagcagggttgtggtcctctgagttcttgaagcagcagcagctgt

SEQ ID NO: 297731 - DNA, 3341 bp, Homo sapiens
aacagagcagtaccccatctgtaaaataaggaaataataaaagaaatacatacattaaaataaaatggaaaatgtcttgccattttacatattttaagaacagtatataatgaatctttaggtatccatcatgaaaatttggtaataactcacctatgtgcaatctcccctatctggaaatcttcttggccatatgtattaagagaatcctaatgcattttattgcttcaaatatggtccaaatgcaggaatcactttgccttttttctctctctctttctccctttctatcccacccaccccatcctggctctttcagtttttattttcagcactgcagctctgatggtccagctccaccaggacacagatccccagatccctaaaggtcagccatgcaccctgaacagctcagagggaggagccagaccagcagtgcctcacaccttgttctcttctgctctagacagatggctccataatgacagcttcataatggcagtgggtgagcccctggtgcacatcagggtcactcttctgctgctctggtttgggatgtttttgtctatttctggccactctcaggccaggccctcccagtatttcacttctccagaagtggtgatccctttgaaggtgatcagcaggggcagaggtgcaaaggctcctggatggctctcctatagcctgcggtttgggggacagagatacattgtccacatgagggtaaataagctgttgtttgctgcacaccttcctgtgttcacctacacagagcagcatgccctgctccaggatcagcccttcatccaggatgactgctactaccatggttatgtggagggggtccctgagtccttggttgcccttagtacctgttctgggggctttcttggaatgctacagataaatgaccttgtttatgaaatcaagccaattagtgtttctgccacatttgaacacctagtatataagatagacagtgatgatacacagtttccacctatgagatgtgggttaacagaagagaaaatagcacaccagatggagttgcaattgtcatataatttcactctgaagcaaagttcttttgtgggctggtggacccatcagcggtttgttgagctggtagtggtcgtggataatattagatatcttttctctcaaagtaatgcaacaacagtgcagcatgaagtatttaacgttgtcaatatagtggattccttctatcatcctttggaggttgatgtaattttgactggaattgatatatggactgcatcaaatccacttcctaccagtggagacctagataatgttttagaggacttttctatttggaagaattataaccttaataatcgactacaacatgatgttgcacatcttttcataaaagacacacaaggcatgaagcttggtgttgcctatgttaaaggaatatgccagaatccttttaatactggagttgatgtttttgaagacaacaggttggtcgtttttgcaattactttgggccacgagcttggtcataatttgggtatgcaacatgacacccagtggtgtgtgtgcgagctacagtggtgcataatgcatgcctatagaaaggtgacaactaaatttagcaactgcagttatgcccaatattgggacagtactatcagtagtggattatgtattcaaccgcctccatatccagggaatatatttagactgaagtactgtgggaatctagtggttgaagaaggggaggaatgtgactgtggaaccatacggcagtgtgcaaaagatccctgttgtctgttaaactgtactctacatcctggggctgcttgtgcttttggaatatgttgcaaagactgcaaatttctgccatcaggaactttatgtagacaacaagttggtgaatgtgaccttccagagtggtgcaatgggacatcccatcaatgcccagatgatgtgtatgtgcaggacgggatctcctgtaatgtgaatgccttctgctatgaaaagacgtgtaataaccatgatatacaatgtaaagagatttttggccaagatgcaaggagtgcatctcagagttgctaccaagaaatcaacacccaaggaaaccgtttcggtcactgtggtattgtaggcacaacatatgtaaaatgttggacccctgatatcatgtgtgggagggttcagtgtgaaaatgtgggagtaattcccaatctgatagagcattctacagtgcagcagtttcacctcaatgacaccacttgctggggcactgattatcatttagggatggctatacctgatattggtgaggtgaaagatggcacagtatgtggtccagaaaagatctgcatccgtaagaagtgtgccagtatggttcatctgtcacaagcctgtcagcctaagacctgcaacatgaggggaatctgcaacaacaaacaacactgtcactgcaaccatgaatgggcacccccatactgcaaggacaaaggctatggaggtagtgctgatagtggcccacctcctaagaacaacatggaaggattaaatgtgatgggaaagttgcgttacctgtcactattgtgccttcttcctttggttgcttttttattattttgcttacatgtgctttttaagaaacgcacaaaaagtaaagaagatgaagaaggataagagaaatgggaaaaagaaggagactaaactttatacttcatttttaatatccaattttttaatagaaaaatatgaagccatgtctcactgtttaaataaaacttcatggacatttcatgtcaggattgcaagcattagctatcacagcaaaggattcctagcctattcttacttactctacagtgtcttaagcaatattaaaggttccttttcccagaagttgtgtctttatgtttcctgagcaaaggcacagaaaagatagtttcaagctgttgtccctcatttttaactctcctctctctctctctctttttttttttttttttgctgtactatgtaatgttcaggatgtgcctgtacacaactcatttctgtttggcacattcagctgtgccaaagggggcagtagaagtagcctggagtgatgatgagggaagaagggagctttctttcctgtgtgcttaccatgagtgtcaccattattttggttggggccattcactctggcaattatatttggtttcagattccagttctgttgtcacttttagaaccaccctcatttttccttagaaataccagcagcagttggacactgacctccttaggggtccgggagtgagcagggttgtggtcctctgagttcttgaagcagcagcagctgt

SEQ ID NO: 297732 - DNA, 2802 bp, Homo sapiens
ctccattggatgggagttcagcagtgtgtttaagactagggtcatgcccacatcaatctcagattcccattttatctttcttttttggtatcactcctagtaccaagtcttgtgtctgtcaatatcctgtccaaaaaagaaaaacacaccaaggaaaattaatataggaaaaatttaaaaagttattagaggactgaaaatataaaaatggaacactgaaagacacagagtttttattttcagcactgcagctctgatggtccagctccaccaggacacagatccccagatccctaaaggtcagccatgcaccctgaacagctcagagggaggagccagaccagcagtgcctcacaccttgttctcttctgctctagacagatggctccataatgacagcttcataatggcagtgggtgagcccctggtgcacatcagggtcactcttctgctgctctggtttgggatgtttttgtctatttctggccactctcaggccaggccctcccagtatttcacttctccagaagtggtgatccctttgaaggtgatcagcaggggcagaggtgcaaaggctcctggatggctctcctatagcctgcggtttgggggacagagatacattgtccacatgagggtaaataagctgttgtttgctgcacaccttcctgtgttcacctacacagagcagcatgccctgctccaggatcagcccttcatccaggatgactgctactaccatggttatgtggagggggtccctgagtccttggttgcccttagtacctgttctgggggctttcttggaatgctacagataaatgaccttgtttatgaaatcaagccaattagtgtttctgccacatttgaacacctagtatataagatagacagtgatgatacacagtttccacctatgagatgtgggttaacagaagagaaaatagcacaccagatggagttgcaattgtcatataatttcactctgaagcaaagttcttttgtgggctggtggacccatcagcggtttgttgagctggtagtggtcgtggataatattagatatcttttctctcaaagtaatgcaacaacagtgcagcatgaagtatttaacgttgtcaatatagtggattccttctatcatcctttggaggttgatgtaattttgactggaattgatatatggactgcatcaaatccacttcctaccagtggagacctagataatgttttagaggacttttctatttggaagaattataaccttaataatcgactacaacatgatgttgcacatcttttcataaaagacacacaaggcatgaagcttggtgttgcctatgttaaaggaatatgccagaatccttttaatactggagttgatgtttttgaagacaacaggttggtcgtttttgcaattactttgggccacgagcttggtcataatttgggtatgcaacatgacacccagtggtgtgtgtgcgagctacagtggtgcataatgcatgcctatagaaaggtgacaactaaatttagcaactgcagttatgcccaatattgggacagtactatcagtagtggattatgtattcaaccgcctccatatccagggaatatatttagactgaagtactgtgggaatctagtggttgaagaaggggaggaatgtgactgtggaaccatacggcagtgtgcaaaagatccctgttgtctgttaaactgtactctacatcctggggctgcttgtgcttttggaatatgttgcaaagactgcaaatttctgccatcaggaactttatgtagacaacaagttggtgaatgtgaccttccagagtggtgcaatgggacatcccatcaatgcccagatgatgtgtatgtgcaggacgggatctcctgtaatgtgaatgccttctgctatgaaaagacgtgtaataaccatgatatacaatgtaaagagatttttggccaagatgcaaggagtgcatctcagagttgctaccaagaaatcaacacccaaggaaaccgtttcggtcactgtggtattgtaggcacaacatatgtaaaatgttggacccctgatatcatgtgtgggagggttcagtgtgaaaatgtgggagtaattcccaatctgatagagcattctacagtgcagcagtttcacctcaatgacaccacttgctggggcactgattatcatttagggatggctatacctgatattggtgaggtgaaagatggcacagtatgtggtccagaaaagatctgcatccgtaagaagtgtgccagtatggttcatctgtcacaagcctgtcagcctaagacctgcaacatgaggggaatctgcaacaacaaacaacactgtcactgcaaccatgaatgggcacccccatactgcaaggacaaaggctatggaggtagtgctgatagtggcccacctcctaagaacaacatggaaggattaaatgtgatgggaaagttgcgttacctgtcactattgtgccttcttcctttggttgcttttttattattttgcttacatgtgctttttaagaaacgcacaaaaagtaaagaagatgaagaaggataagagaaatgggaaaaagaaggagactaaactttatacttcatttttaatatccaattttttaatagaaaaatatgaagccatgtctcactgtttaaataaaacttcatggacatttcatgtcaggattgcaagcattagctatcacagcaaaggattcctagcctattcttacttactctacagtgtcttaagcaatattaaaggttccttttccc

SEQ ID NO: 297733 - DNA, 3872 bp, Homo sapiens
  misc_feature (1547)..(1547): n is a, c, g, or t
  misc_feature (3122)..(3122): n is a, c, g, or t
ctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattanatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatntgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgtttaaaaaagtgt

SEQ ID NO: 297734 - DNA, 2075 bp, Homo sapiens
  misc_feature (1325)..(1325): n is a, c, g, or t
ccatgcttgtgctctgattattacagaggccctgaagcatcgagtttgcaacacttgatgaattaagtcatattgtatctggatttaatatatccttaaaagtcatttagtctgaattaatggttgtttgtcttttcttttgcagcaaagaaatttgttcctgccagcagctgccaaagccttgaatcagatggaagctaccaaaagccttcttacatcctttaagttcaaaagaatcagagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatntgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgtttaaaaaagtgt

SEQ ID NO: 297735 - DNA, 542 bp, Homo sapiens
gtgcagaacgctttataagggcagcctcgggccatgaaacacagatatgcaaaaggccttctaataaaaaccacatctgtacaagctcttattgtattgtagctaaaacctgtcttttctctttgacctaaataatgaaagtcttaaaatttgtttatttatttgattaaactctgaaataaagattattgcactagtgtcctttgcccaaaatcttaggatgctgccttaaacatcatggtagaataatgtaactagctacccacgatttccttctttaattcattttgtgttttatctccccaggaaagtatttcaagcctaaacctttgggtgaaaagaactcttgaagtcatgattgcttcacagtttctctcagctctcactttgggtaagtcagtgccattagaccaagatttctcattctcgcactatagatatttcagactgaaatatccttgcttgtctggggctgtcctgcacaggatatctggcagcatccttgacctctacctgcaatgtgttcttccctgggcttgggg

SEQ ID NO: 297736 - DNA, 2571 bp, Homo sapiens
cagatcagagtgtatcagagaaagctgcacaaaagaggcaggcagcccaggaccctgagtactctggagaaactaggttccttccccaccctttaagaagacattccgtgcattagatgtactagagtggatgtattttgttgttttttaaattaactatttagcctcctcatcccccaccaaaaaagccatttagttattttttggttatattgatccatttgcaaatgagaagccagaaaagggagcagtcagggagggacttacaagttcctttcaagtttgagtacttgatgctcagcaaagatttcaagcttctgcagtagctctgggccaatgcttgactctttcatgaccacaagaaatgcagtttttctgcaaagggatccaaggtgaggtgtgtgtagggtttgaagttatacttctgggaagtgaaaagtcttgttcctttcaacctagaaataggtttgccacttaatgagtgagcagtaagtctgtgtaagaggctgaatgcatgcccctcagataagccagtacactccttgcttagcaacagaacatcagggtgatgtggagaggggcaggatgtggacgccactttggaaatcggcaacatctgagggcaacaacaaacaagtgtgttgggaaataagaaataactcagttttgacaactggctttgtcagcttttgtgatgtttctttagcagtttattggaaagatggtatgagatgacgtgctgcttcattgaattgctctttcccccatctttgccaaatctcaatgtatcgttcttaaccccacctcctgtaaggggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgttttcaatattaaacttccccaaggaaagcacaaactagtctttttggaaagggagaaaggattaagccacacagtattagtctttgaagcagtactggtctctaggggctggtgccaaaatggagtcccatagtagttacactcgatggcctcatgtactatatactgtgccaaattgtattaaacagtggtggggagttactgggataagaacttgtctaaaagtttacaaaccaaaacagatctgttaggttggtgcaaaagtaagtttttgccatacttaatgtattgccattaagtatggcaaaaaccacaattacttttacaccaacctatgtatttaagaatgtttggtttgccagattccaaatgaggtcttcagtgcagcaaagcccaaaaggtgtagactcagttatgcaattataaggttaaggcgtagaagaaagctgctgctaggtttttgttgcattttacttgactgctctgctgtttttcttgtctctcatgtttggttagctatgacttgagcatcttggtaactgacaaaggtcttccttgggggacttgaacatcttggtaaatgacaggtcttcttggaggactccagcagtatcttgtttaaacgactgaaaggactattaaggttgttgaattgtgttaattgggactcattgaggaaatgcgacattgatcctcctcttattccacagtgtgttttctgatcatataaagaaggttccgaaccatccatccccctcagagtttattcccctggtaagctgtaattgcatatccagtttaaactggactgggactgcatgttggtgaggatcggcaggggttttcccccttttcgaaagatgaaatagattcttgagcactggttgcagaagccaaaatagttcaaatagctttgcataaccattgggttctgcttctgattcaggtgctgggcatcatgtcctccctattcttctcttcttggaaacccagcctatctcataaatacctacttccgccacccatccaacctccctgctcctttcaacacaaatcttggatattgccaaaggaagccattcagcagctgctggggtttttcatccccctgacatgcatacatttgctctgggagaagtgtcttccctctgaccctggtccccagctccgtctgtgcttaattgctcttacctgttgcactaatgaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttg

SEQ ID NO: 297737 - DNA, 2600 bp, Homo sapiens
cagatcagagtgtatcagagaaagctgcacaaaagaggcaggcagcccaggaccctgagtactctggagaaactaggttccttccccaccctttaagaagacattccgtgcattagatgtactagagtggatgtattttgttgttttttaaattaactatttagcctcctcatcccccaccaaaaaagccatttagttattttttggttatattgatccatttgcaaatgagaagccagaaaagggagcagtcagggagggacttacaagttcctttcaagtttgagtacttgatgctcagcaaagatttcaagcttctgcagtagctctgggccaatgcttgactctttcatgaccacaagaaatgcagtttttctgcaaagggatccaaggtgaggtgtgtgtagggtttgaagttatacttctgggaagtgaaaagtcttgttcctttcaacctagaaataggtttgccacttaatgagtgagcagtaagtctgtgtaagaggctgaatgcatgcccctcagataagccagtacactccttgcttagcaacagaacatcagggtgatgtggagaggggcaggatgtggacgccactttggaaatcggcaacatctgagggcaacaacaaacaagtgtgttgggaaataagaaataactcagttttgacaactggctttgtcagcttttgtgatgtttctttagcagtttattggaaagatggtatgagatgacgtgctgcttcattgaattgctctttcccccatctttgccaaatctcaatgtatcgttcttaaccccacctcctgtaaggggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgttttcaatattaaacttccccaaggaaagcacaaactagtctttttggaaagggagaaaggattaagccacacagtattagtctttgaagcagtactggtctctaggggctggtgccaaaatggagtcccatagtagttacactcgatggcctcatgtactatatactgtgccaaattgtattaaacagtggtggggagttactgggataagaacttgtctaaaagtttacaaaccaaaacagatctgttaggttggtgcaaaagtaagtttttgccatacttaatgtattgccattaagtatggcaaaaaccacaattacttttacaccaacctatgtatttaagaatgtttggtttgccagattccaaatgaggtcttcagtgcagcaaagcccaaaaggtgtagactcagttatgcaattataaggttaaggcgtagaagaaagctgctgctaggtttttgttgcattttacttgactgctctgctgtttttcttgtctctcatgtttggttagctatgacttgagcatcttggtaactgacaaaggtcttccttgggggacttgaacatcttggtaaatgacaggtcttcttggaggactccagcagtatcttgtttaaacgactgaaaggactattaaggttgttgaattgtgttaattgggactcattgaggaaatgcgacattgatcctcctcttattccacagtgtgttttctgatcatataaagaaggttccgaaccatccatccccctcagagtttattcccctggtaagctgtaattgcatatccagtttaaactggactgggactgcatgttggtgaggatcggcaggggttttcccccttttcgaaagatgaaatagattcttgagcactggttgcagaagccaaaatagttcaaatagctttgcataaccattgggttctgcttctgattcaggtgctgggcatcatgtcctccctattcttctcttcttggaaacccagcctatctcataaatacctacttccgccacccatccaacctccctgctcctttcaacacaaatcttggatattgccaaaggaagccattcagcagctgctggggtttttcatccccctgacatgcatacatttgctctgggagaagtgtcttccctctgaccctggtccccagctccgtctgtgcttaattgctcttacctgttgcactaatgaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttgaatattgatatttctacaaaaaaaaaaaa

SEQ ID NO: 297738 - DNA, 2554 bp, Homo sapiens
cagatcagagtgtatcagagaaagctgcacaaaagaggcaggcagcccaggaccctgagtactctggagaaactaggttccttccccaccctttaagaagacattccgtgcattagatgtactagagtggatgtattttgttgttttttaaattaactatttagcctcctcatcccccaccaaaaaagccatttagttattttttggttatattgatccatttgcaaatgagaagccagaaaagggagcagtcagggagggacttacaagttcctttcaagtttgagtacttgatgctcagcaaagatttcaagcttctgcagtagctctgggccaatgcttgactctttcatgaccacaagaaatgcagtttttctgcaaagggatccaaggtgaggtgtgtgtagggtttgaagttatacttctgggaagtgaaaagtcttgttcctttcaacctagaaataggtttgccacttaatgagtgagcagtaagtctgtgtaagaggctgaatgcatgcccctcagataagccagtacactccttgcttagcaacagaacatcagggtgatgtggagaggggcaggatgtggacgccactttggaaatcggcaacatctgagggcaacaacaaacaagtgtgttgggaaataagaaataactcagttttgacaactggctttgtcagcttttgtgatgtttctttagcagtttattggaaagatggtatgagatgacgtgctgcttcattgaattgctctttcccccatctttgccaaatctcaatgtatcgttcttaaccccacctcctgtaaggggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgttttcaatattaaacttccccaaggaaagcacaaactagtctttttggaaagggagaaaggattaagccacacagtattagtctttgaagcagtactggtctctaggggctggtgccaaaatggagtcccatagtagttacactcgatggcctcatgtactatatactgtgccaaattgtattaaacagtggtggggagttactgggataagaacttgtctaaaagtttacaaaccaaaacagatctgttaggttggtgcaaaaaccacaattacttttacaccaacctatgtatttaagaatgtttggtttgccagattccaaatgaggtcttcagtgcagcaaagcccaaaaggtgtagactcagttatgcaattataaggttaaggcgtagaagaaagctgctgctaggtttttgttgcattttacttgactgctctgctgtttttcttgtctctcatgtttggttagctatgacttgagcatcttggtaactgacaaaggtcttccttgggggacttgaacatcttggtaaatgacaggtcttcttggaggactccagcagtatcttgtttaaacgactgaaaggactattaaggttgttgaattgtgttaattgggactcattgaggaaatgcgacattgatcctcctcttattccacagtgtgttttctgatcatataaagaaggttccgaaccatccatccccctcagagtttattcccctggtaagctgtaattgcatatccagtttaaactggactgggactgcatgttggtgaggatcggcaggggttttcccccttttcgaaagatgaaatagattcttgagcactggttgcagaagccaaaatagttcaaatagctttgcataaccattgggttctgcttctgattcaggtgctgggcatcatgtcctccctattcttctcttcttggaaacccagcctatctcataaatacctacttccgccacccatccaacctccctgctcctttcaacacaaatcttggatattgccaaaggaagccattcagcagctgctggggtttttcatccccctgacatgcatacatttgctctgggagaagtgtcttccctctgaccctggtccccagctccgtctgtgcttaattgctcttacctgttgcactaatgaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttgaatattgatatttctacaaaaaaaaaaaa

SEQ ID NO: 297739 - DNA, 536 bp, Homo sapiens
agcctttagaggctacactgagtcctctttttcatgctcttcctggttttcaagtgtcaattaaaatttgtcttcagaagaaacttgaaaataagtatctgatgccgtcatcaggatagactagtattagctttcgcagctgaagttattgctctcccagccctaataataacttaccaagtgcttattatttatcaggcactggtccaagtccttcaatcagattgtctcacctgatcctcccaacagccctaggaagcaggtcttactacactccccatttcacagggactggggcttggggaggtgatgcggtttcctgggtcactccattactgagtagtgagacaggattcagacgcaagctttgaaaatgttctaattttctttagaaggaagggcccttcttaatagcacactgaataaaatcaaatgaataatcacacattacaagatgcctcctatacgtctctatatttagctacttacataccaggtttcttttttgtttgtttttgtttttgagactcatctca

SEQ ID NO: 297740 - DNA, 1152 bp, Homo sapiens
tccatggttctcagccttctctttgcatcaaattcagctggagttttaaaagatacagatactaagtccctacccctagcaattgtgatataatagatctggggtggggcctgggccatggtgggtattaaaagctctgctgtgcagccagggttgagatcttcagctgcagctcagggggatccaccacgtcacacagggctcctagtccaagagctgctgggagaatcagggacctggctcatagggatcattgagagaataatcctctcagctgctgagcactggtgccccctgccccatctggttgactcttactccagggtgctataaaaatagcattttccatgtgtgccatgaaggcaaaaagatctaagctgagccagagcccctggatcagggatactcacaggatgtaggtgatgacgcctatgctcctgcaaaataaagaacagtcaagtcagggccacctgggtcccatccccgaccagcaagggacaccctcatggatctaaggggaagaggtcacttgcctcctccacagcagaccctggatgccgtctcatgctccacacccatctccatcctgctcttcagcagcagcccggggtgtgtttggagtcatcgagctctgaaccctgagtccgaagacccaagttcaagatcagactcctgcacttgcaggctgtgtgatttagatgacactttttaaaagcttggagatcatggaggcaaaaaagaggacagtagcttgagaaggaggaaggactgagcccattcaactgcgaatggaaaaggtggagagtgggaaagtgtatttgtcttccctgactgctttgtcttggtacccttcagtttcactataatgtgtctaggtaagatttttgtttttttctgcctggtatatattgtcctttctgtgtctgtggatgcatggatgcagttctgaaaattctcagccattctcttcaaatagtgcttctcctttttttctttttgtatctatttcctccttttagaattccaaagagatctatgataagttttctttttatcctcttttgcttatcctctctttcatatttctatgtctttgtcactctatggtgctctagctaatttgtttcagctctttcaattcttcaactctct

SEQ ID NO: 297741 - DNA, 531 bp, Homo sapiens
tccatggttctcagccttctctttgcatcaaattcagctggagttttaaaagatacagatactaagtccctacccctagcaattgtgatataatagatctggggtggggcctgggccatggtgggtattaaaagctctgctgtgcagccagggttgagatcttcagctgcagctcagggggatccaccacgtcacacagggctcctagtccaagagctgctgggagaatcagggacctggctcatagggatcattgagagaataatcctctcagctgctgagcactggtgccccctgccccatctggttgactcttactccagggtgctataaaaatagcattttccatgtgtgccatgaaggcaaaaaggttgggaagggctgatggaatgaatactcactagcccactgtgcatgttccagagtcagggctaggagacttgcgcatgttgacttatttagctttcacaacacacccatggcaggaagtttgtgattcctatttttctcatgagaaaaacaagcccagag

SEQ ID NO: 297742 - DNA, 1163 bp, Homo sapiens
tccatggttctcagccttctctttgcatcaaattcagctggagttttaaaagatacagatactaagtccctacccctagcaattgtgatataatagatctggggtggggcctgggccatggtgggtattaaaagctctgctgtgcagccagggttgagatcttcagctgcagctcagggggatccaccacgtcacacagggctcctagtccaagagctgctgggagaatcagggacctggctcatagggatcattgagagaataatcctctcagctgctgagcactggtgccccctgccccatctggttgactcttactccagggtgctataaaaatagcattttccatgtgtgccatgaaggcaaaaagatctaagctgagccagagcccctggatcagggatactcacaggatgtaggtgatgacgcctatgctcctgcaaaataaagaacagtcaagtcagggccacctgggtcccatccccgaccagcaagggacaccctcatggatctaaggggaagaggtcacttgcctcctccacagcagaccctggatgccgtctcatgctccacacccatctccatcctgctcttcagcagcagcccggggtgtgtttggagtcatcgagctctgaaccctgagtccgaagacccaagttcaagatcagactcctgcacttgcaggctgtgtgatttagatgacactttttaaaagcttggagatcatggaggcaaaaaagaggacagtagcttgagaaggaggaaggactgagcccattcaactgcgaatggaaaaggtggagagtgggaaagtgtgagtttatctaaaacaatatcaaaaccattgcatccacagcctgtgtctgccctcctgtcctcttgcatcctgctactttaagactcagggaactacgctcctggttttgctgctgttttagctttataaaaatgctgtcatactgcatgtgatttatagtcactttattttttcactgaacatttatgcttctagtgttcactgattgttcatccatgctttttacattttcactgctatacggtaatccatcgtgtgaatgtgtatcattttttagtcattctcctctcagagttcatttaaatggctcccattttaaacaattattgaaacgacattgctatga

SEQ ID NO: 297743 - DNA, 424 bp, Homo sapiens
ttcctagtggctgggattacaggtgcgcaccaccacccccaggtaatttttgcatttttaataaggatcccctaggttgaaatgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttctgtgcccatatacaggggatctctagagcgaccagcagca

SEQ ID NO: 297744 - DNA, 8037 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297745 - DNA, 8095 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaacagtgataacgatttaggtcctgggaattgagtgctactttatcttcacaagccttagtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297746 - DNA, 7743 bp, Homo sapiens
cagaggaacagggcaaacctctgacttccggcggcattttgaggcggtcctcctagcggcctgtagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297747 - DNA, 6039 bp, Homo sapiens
cagagaaagatcaaagattgatcagtgggaggggggaagggggttgacggggagcaggaaacatggtcgttagagggcaaataaaaattatctttaaaaaatttaaggtctaggggcgattgttacttggatattaagttaaaattaaatatgcttacttggtttgtaatttgttgccagtgtgaccctatacacagataaaatttaagatttaccatgctgtcttaccaataggttatctgtcaaattaatcactgacaaaacttgattttcattgtagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297748 - DNA, 6051 bp, Homo sapiens
ctcccttccaccagcctcccttccaccagtctcccttccaccagtcgtccctgccaccagccgtcccgtcgtcccttccactagccgcccttccaccagcctcccttccaccagcctcccttctcccttccaccagtctcctttccaccagcgtatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297749 - DNA, 6706 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaaggtagtttcattttactttaactatataatgtctgttaaccatttaagatgccatctgaaggggattctgatctgttcttatgtagcacttaacactgtgtagaaactattttttgagaaatcattttataatcattatttaaccctcatggtcaaagtttctctttaaaatttattttgagaagaagagttatcccacagaaaagttgggaaaagagtacaatgacctttttgtatgaaaattacttattaacaggccaggcgtggtgttgcatgtctgtagtcacagctactcagggaggttgaggcagcaggattgctggagcccaggaaattgaggctgcagtgagccatgattgagccaccacactccaacctaggtgacagagcaagaccctgtctcaaaaaaaaaaaaacaaattaaccaataagttctaatatcaaagtgctcagtggtttgcccttggctaaatgaagcagagccaggaaaaacagactacatatttttcatgtctaaagaaattgggtattttggcagccctttcccctagacatctacccaaatgcaggtgtgtaggttgagtctttaacaaagtgattaagagcttggtctgtaaggccggatgatctggatttcagtaggcacaccacttactggctattacttaatctgtgtgttagtgtcatcatctgtaagtcaggaataatcataccaccaacttcctatggtaattaggagcaaatgagttattacaggcaaaacacttagaacagttcctggcatatagtaatacccaataaatattaactgctactttgaaaatatcctatcacgctgatttttgacctcactgcagcaattttcagttattccagattatctagcttatggattctggtggtaggggttgtttggttttggttttcactgtctctgtctcatctagtacctaccttagtttattttgcaacttactaatactttattaatggggagggacgagtagatggtaaaaagaaggaaaaggaggtaaaaggtgaaaggaacaacattaattaacaattttacgtcatgtccctggacataaaagtttagttagtattaaatttttcactaatacaaaataaaaaaatattgttttatgagttttatgaattcatgcccttcctttactctattagcataagcagtaaatttttttattttaatatagcccaataaacctagagtatacatgtacaaaatacatataattgttaacgtgtattaaccgaaaaatgacccaagacttagttcttgccctactgtatctgccttgtttggttggttctgtgaccttaagcaaataactcctgtgagcctcaattttatttgtaaagtgatggaataaaacccctaaaatcttacccacctctaaagatatttgtttctgtgaccttttgctagtagcatttcaagttaaaatctggtttgattttgctacccatgaaatacagttcggcccttacttattgatgacttaacctaaacagtgaaaatatgcactgtaaagggtggggtgatgtggcttaacaatcagacttcttctatttttgctgctatggtggttgtattagagaactgatgtattatcttgaataaagactttgtcttgtttactgccct

SEQ ID NO: 297750 - DNA, 7999 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297751 - DNA, 7368 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaacctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297752 - DNA, 6183 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297753 - DNA, 6056 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttcc

SEQ ID NO: 297754 - DNA, 4884 bp, Homo sapiens
gcggccgctactactaaattcgcggccgcgtcccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297755 - DNA, 4196 bp, Homo sapiens
agcgaaaacggcatcttcatcggacgaaaacggcatcttcatcggccgatgaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297756 - DNA, 2318 bp, Homo sapiens
ggcaggcgatctagaggatcccaatcagttacacaaaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297757 - DNA, 1641 bp, Homo sapiens
aactgatttttcctcctacatagttgtatgttgttattttagcttgcttttttatgacaatttctgtgcccatttcaattgaaatgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297758 - DNA, 2456 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacaatccagcagcccaggaggtcgacgcggccgc

SEQ ID NO: 297759 - DNA, 2006 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagaagatatcgctctggggaaaaaatacaaagaaaaatataaagtaaaagacaggatagaagaaaaaacaagagatggaaaggacagcagagaaattcaaaaaccaaccaaagtaaaaagaaaggaccacgtactcctagtccaccccctcctataccagaagatatcgctctggggaaaaaatacaaagaaaaatataaagtaaaagacaggatagaaga

SEQ ID NO: 297760 - DNA, 1314 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagaggtcagtagggtgataaatagtatcgagaaaatagctttttctgaagtgatactaaaaagaattagtaggttataaaagggtacttttagtacattttatatttaatgtaagcttttttgttctaaaaagaaatttgaaatgtttcaattaaaaagacaattatagagaacaataaaacaaacatctgtgtaacatccacata

SEQ ID NO: 297761 - DNA, 657 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaagtaagcgttctgtgaattggtgtgggtatctggggaaggcattgagcggacccgtaatgcggaggcccgggttacccacccccgtctttgcttgagtcactgggattttgagctttccttgagcatcccacccttaactctgcaatagccccctgtgctcaggcgtaatttctcactctgattatgattctggcatttgtctaagggcgataagtagactcagacaataggctgtacccctcgttaccatttgatgtaagcacgggaacccttgtatggtgttcgtatttgtgtgcgatg

SEQ ID NO: 297762 - DNA, 214 bp, Homo sapiens
aatctgaagtttggtgtgattctaaaatactgtaagtcttgttgtaccataagtggaggaatttctgaattgacttactgaatttttttaaaggtttcaccagaagtggttagatcaaaattgtccccgtcaccttctctaagaaagtctagcaaatctccgaagcgaaaatcaagcccgaagtcgtcttcagctagcaagaaagataggaaga

SEQ ID NO: 297763 - DNA, 482 bp, Homo sapiens
tattataatctatatgtaccatgcagtggttactaacctggtgagagtgtgattgcttttatcttttatatagatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcacc

SEQ ID NO: 297764 - DNA, 5722 bp, Homo sapiens
gcggccgctactactaaattcgcggccgcgtcaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297765 - DNA, 8135 bp, Homo sapiens
  misc_feature (3148)..(3148): n is a, c, g, or t
  misc_feature (3152)..(3152): n is a, c, g, or t
  misc_feature (3158)..(3158): n is a, c, g, or t
  misc_feature (3160)..(3160): n is a, c, g, or t
  misc_feature (3162)..(3162): n is a, c, g, or t
  misc_feature (3164)..(3165): n is a, c, g, or t
  misc_feature (3167)..(3167): n is a, c, g, or t
  misc_feature (3170)..(3171): n is a, c, g, or t
  misc_feature (3203)..(3203): n is a, c, g, or t
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagaaaaagagagagaactagaaagagagcgtgctagggaacgggagagagaaagagaaaaagagagagatcgtgaaagggatanagancgagancncnanngnganngggaaagagagagggaacgagacagggaaaangaacgggaacgagaaagagaagagagagagagggaaagcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtgggataatatggttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgtgtctttcagtttgaaatcttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaa

SEQ ID NO: 297766 - DNA, 6822 bp, Homo sapiens
cagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatagtacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctgggcacagaaattgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttctgtgcccatatacaggggatctctagagcgaccagcagca

SEQ ID NO: 297767 - DNA, 441 bp, Homo sapiens
caataaacagagaattatgggagttatcactgcaaggaaaatgatgagactcactagccttttttcaaatttgctttcaaatattatgtgtttcattcagtttttatgacttttatttctgctgttctccctttcccaacccagatatttacatgcatttgggaaatactccagagaccataactacaagtacctttaataatactgcctaatcattttcagaaatctgatgaatagaaggatgttagaagtgctgaagaaagaaaatgctaagtgaaattagccgggcatggtggccaggcgcctgtaatcccagctactcgggagcctgaggcaggagaattgcttgaactcgggaggcggaggttgcagtgagccgagatcacgccattgcaatccagcctgggtgacaagagtgaaactccgtctcaaaaaaaaaaa

SEQ ID NO: 297768 - DNA, 2216 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297769 - DNA, 2514 bp, Homo sapiens
  misc_feature (5)..(5): n is a, c, g, or t
  misc_feature (7)..(8): n is a, c, g, or t
cagcngnntggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcagctagctgagcagaggagtaagtgggcaacaggtgggacagccatggctgagtccgtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297770 - DNA, 2174 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297771 - DNA, 459 bp, Homo sapiens
ttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297772 - DNA, 2357 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297773 - DNA, 2394 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacagatactaagtatttactttgtaccaaacacgatgccaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297774 - DNA, 2298 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297775 - DNA, 2822 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297776 - DNA, 2579 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297777 - DNA, 2520 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297778 - DNA, 2211 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaaggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297779 - DNA, 2070 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaaggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297780 - DNA, 2352 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatta

SEQ ID NO: 297781 - DNA, 2623 bp, Homo sapiens
  misc_feature (2565)..(2565): n is a, c, g, or t
  misc_feature (2596)..(2596): n is a, c, g, or t
  misc_feature (2617)..(2617): n is a, c, g, or t
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggggatttttgcccagtngacaaaggccgggaagttcctgttattaccnggttgttattggcccttttgncaacca

SEQ ID NO: 297782 - DNA, 1632 bp, Homo sapiens
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatat

SEQ ID NO: 297783 - DNA, 292 bp, Homo sapiens
gtactggggatacgatggctgattcgatagatctggttcctgccctcagtgcgtatactgctccccactttcgttgatgtggtagtggtgatgactgagccaaccacctaatgtggaaatgagaggacagcaagattgtgggtatggaatggggcaaagcaataagggaaaattagtgtggcagggttcagtacagcagcctgggttcccatttccccccatattcaaatgctgacactctcttctcctcccaggtccagcctgtggtgtccacaatgccccaggcctctga

SEQ ID NO: 297784 - DNA, 2133 bp, Homo sapiens
acccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297785 - DNA, 1549 bp, Homo sapiens
agcagagtgtggttgccatggtggttgtggtaggagactgtggtggccgggggactgctgccggccacgtggttgctgggcaggtgtggggtcaggctgtggatcccggcagctcatcctggcgtcatgagccaggggtaggggctgagctatggctcccctgccggtcagtgcccaccaggggcacggtgacctcctaactgcacccctgccccttggcccccaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297786 - DNA, 1399 bp, Homo sapiens
tggctaaggtagaggcggggttactcggacgagggtcccgaccgactcatatcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297787 - DNA, 2341 bp, Homo sapiens
caagaatgaatgaaatcgtagcgcgctgggcggcagagcgggcggcgcaggccggggctgggcccgcgcgcggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297788 - DNA, 2235 bp, Homo sapiens
acccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297789 - DNA, 2321 bp, Homo sapiens
tcttgcttcctcttcgggatcccggactccacgttggtggatctacaggcgatggggcccctcaccctgaccctggcccagacccctgggaggaggtgtgctacagccgtgagcaggggcccagctacacctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297790 - DNA, 1637 bp, Homo sapiens
agggtggaggcggcaggggcccggaggggctgacaggccctcctggctcgctcgctccccagtctgtgggaaacggtataagaaccggccggggctcagctaccactacacccacacccacctggccgaggaggagggggaggagaacgccgaacgccacgccctgcccttccaccggaaaaacaaccataaacccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 297791 - DNA, 1087 bp, Homo sapiens
caagaatgaatgaaatcgtagcgcgctgggcggcagagcgggcggcgcaggccggggctgggcccgcgcgcggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaaccacataaacagtttccaagaattgcctgggtccttagccaaggaaccccagcaagaagggcccgaggacgtatcccaggtactgtgattctgcccggggcccgaaaggggccccggaccaccccggggaggggggagggaccctgttaatccggatagggcggaccacgggttgactccgtcgcagagggggccctgtacggactcagcaacacatatgtatcccctctaaacgatcgcc

SEQ ID NO: 297792 - DNA, 555 bp, Homo sapiens
gtggaagacttggaggatgacattcccaggaggaagaacagggccaaaggaaaggtatcaccccaagcttctcctcttccccgctcccctcaatgacaggtctcattcatggagcaggtgcagtggtccgcccctgccacagtctgacctcagtctgacctcattgaatccccagagcggcctgcaggggtgggggattttatacccattttacagatgaggaaactgaggctcatctgtattaagccatttgcaaagcagagattatgcagtgggttagagctaccttcatccccatgccacagaggaagaagctgaaccttggagaggttcaaggccccacagctaggacatttgtacagctgcaatttgaatttgcaaaagacactgttttctcactttcttttttcttttttttcttttttttgagacggagtctcgctctgtcacaggctagagtgcagtggcgcaatatctgctcactgcaacctccgcctcccgggttcaagcgattctcctgcctcagcctcccgagtagctgggactacaggcacg

SEQ ID NO: 297793 - DNA, 721 bp, Homo sapiens
tgaaagaaataggatggaaatagaaatatccaagtagcaaccacaaaaaaactggaatgtctgcactaacatcatacaaaacaaaccaaatgaaggttaaaaatattgaaattatacaaaatatgttctatgactaaaatttaatgaaattagaaataacacagagataggaactatacatatttgtgcaaatttaaaaagttatgctgagtgtggtggctcacacctgtaatcccagcactttgggaggccggggagggtggatcacttgaagtcaggagttggagaccagcctggccaacatggtgaaaccctgtctctactaaaaatacagaaaattagccagatgtggtggtgtgcgcctgtagtcccagctactcgggtggctgaggcactagaatcacttgagcctaggaggcagaggtggcagtgagccgagatcacaccactgcactgcagcctgggcgacaaagactgtcaaaaaaaaaaaaaaaaaaaaaaagttacgtaaccaacaagtcaaaggagaatttataaggaaatcagaaaatactttgaggtgaatgaaaatacagaaacaacatatcaaattctgtgagatgtgtgaaagcaacgcttacagtgaaattaatagctatgaacattgtaatgaaatgagaagtacttcaaattactaacctaactttccaactttagaaaatacagtaaaaaaagaacaaat

SEQ ID NO: 297794 - DNA, 7185 bp, Homo sapiens
cacaaatctgtgattacctggcgggtgaaccgctccggtggcggggagagcgggctcccagcgctgggtaggggccgggttccggcgagcgccatcccggagcgtcagtttcccagtttgggaagtgaggagaacctgcctcgcccttccccgccaaggcttagggaagggactatggcagttccaagaggaaatcagggtctcgctctgttgctcaggctggattgcagtggcgtgatcatgcctcactgcagcctcgacctccctgggctcaagcaatcctcccacttcagcctccagagtggctgggaccacagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaagtcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatccccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccagtgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttc

SEQ ID NO: 297795 - DNA, 7035 bp, Homo sapiens
tccacaggcacttgtccggctgcccccccacatctcacagtgtgacgaagtcttccggttcttcgaggctcgacccgaggatgtcaaccctccaaaagaggactatggcagttccaagaggaaatcaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaagtcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatccccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccagtgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttc

SEQ ID NO: 297796 - DNA, 4620 bp, Homo sapiens
  misc_feature (42)..(42): n is a, c, g, or t
  misc_feature (88)..(88): n is a, c, g, or t
caccgaagtttgagcatggttggctgctttggccccggcggnaagcttgactggctgctaggctgctggctgcttggccacagacggncgcacggagacactcgacgccactcccaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatccccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccagtgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttc

SEQ ID NO: 297797 - DNA, 2884 bp, Homo sapiens
tccacaggcacttgtccggctgcccccccacatctcacagtgtgacgaagtcttccggttcttcgaggctcgacccgaggatgtcaaccctccaaaagaggactatggcagttccaagaggaaatcaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaagtcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctgccggcggccggcgcggcctcgtcgccgtccgcgcccggcacgttgaggtcgcataggctcaccgagaggcgcgcgtcgtccgcctcgcgccgcagcgacggccgccgcagggcggtgaaggagcgcggccgc

SEQ ID NO: 297798 - DNA, 1242 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaaaaaaaaag

SEQ ID NO: 297799 - DNA, 3643 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 297800 - DNA, 1188 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggtgcaggcgcgtgatctaggctcactgcaagctctgcctcccaggttgaagtgattctcctgtgaaagggaattatttttgatgagtcattaaagtatatccattcccagaaaaaaaaag

SEQ ID NO: 297801 - DNA, 206 bp, Homo sapiens
atcattacttacacaccataaacccacaccttttaactacaaaaaaacaacttcagaacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaaaaaaaaag

SEQ ID NO: 297802 - DNA, 3185 bp, Homo sapiens
gtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 297803 - DNA, 2976 bp, Homo sapiens
ggttttaccatgttggccagtctggtctcgaactcctgacctcgtgatccacctgcctcagcctccctaagtgctgggattacaggtgtgagccactatgcccggctgccccatcctttttcttgatattatagttagtggtgaaaacatgtaaatgataatactccatgcagtatgtatgctgaagtgactaccctgaagacattttttaagtcctattttcttttctttctaggatatgataatcattttctgtttgtattaatacatgcttgaaaggaattagtaaagcgattccatccttgtcagcagcttggaacaaagctgtggatctggggattgtgtagaactcatttgacatcagtagttacttgtgtctttatgcctcagatcaagatgtgcgtgtttttttctttctccttttagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 297804 - DNA, 2314 bp, Homo sapiens
agaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaacactgagaaaattaaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 297805 - DNA, 3813 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctcttgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 297806 - DNA, 3997 bp, Homo sapiens
  misc_feature (3707)..(3707): n is a, c, g, or t
  misc_feature (3710)..(3710): n is a, c, g, or t
  misc_feature (3717)..(3717): n is a, c, g, or t
  misc_feature (3719)..(3720): n is a, c, g, or t
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaaaaaaaaataaaaaaaaaaaaaaaaaacaaaaaacaacaaaaaaaaaaaaacaaaaaaaaaaanaanaaaacanannacagaaaagaagaagaaaagaaaagaaaacaacaagacaacaataagaaaaacgaggggggggggcgacctaaaaaaccattgcgcaggggggcgcagcacgatagctacaaagagacacacacccgttacagtaaaaagagggagggccacttcagcgggcaggcgcccaaacaaccgcgaagcggggggaaggaaacaagagaccgacggaaggaagagaaagaacgagacggaatgagatggaagagaaccacattagggggggacgacaaggc

SEQ ID NO: 297807 - DNA, 3989 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaccagcaagttttcagtgccagataaaactctgcgctctagaggtaactcctcatgggaggcagctaggagtgttacctgacaccagtttcctagaaaactgtgacaagcaaagcaataacacacgtcgagaaatatctgatcaagcgggaaatcttctgactgtcggggatctctagtaagatctcttggaatgaagtgcactgtgtatccaaaactattttccagcgccagtgaagttgctcttacctaaaacaaatgggtttatgctagtttccaccaaggaatgagtctcgatggccattaaactttctaaggcccacagggctaggaaaagtcgctcttaaa

SEQ ID NO: 297808 - DNA, 3231 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacccaga

SEQ ID NO: 297809 - DNA, 1842 bp, Homo sapiens
ccttttgaaacaatttggaacctgattacaaagttgaaaatccccatctgtatgaagaaaagcttcactggctggtcaccttggctcaacgcctgtaatcccagcactttgtgaggctgaggcgggtggatcacaaggtcaggagtttgagaccagtctggccaacatggtgaaaccccatctctactaaaaatacaaaaataaaaaattagccaggtgtggtggcaaacacctgtagctactcaggaggctgagtcaggagaatcgcttgtgcccgggaggcagaggttgcagtgagccgagatcatgccgctgtactccagcctgtgcgacagggcaagacaccatctccaaaaaaaaaaagcttcactgtgagttatgatatgggaagaaaagtcttggcctggccaccacaaggaatccctcaggcctggcggtgggaagcagaggagggcgcagtctctttagggcagaaagtgaagaacatttctatgacaatggggaaatcagttcacctttgtgttggtaaacaaaaggaatgtaagctgtcctttgagctcgaatcatagtggtgattgccaaaacctacctttgtttttagaagataatagcacatattccacttgcttccccacagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 297810 - DNA, 1486 bp, Homo sapiens
gaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtct

SEQ ID NO: 297811 - DNA, 369 bp, Homo sapiens
gccattattcaccctgcccacacctgctgcccccttcaacctgatgggcttgtctttgttggcgttcagcatgaagattttattgagaagaaaaggtttggagtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctc

SEQ ID NO: 297812 - DNA, 476 bp, Homo sapiens
gatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctc

SEQ ID NO: 297813 - DNA, 384 bp, Homo sapiens
cctcgctcctgtcgacctctgacacacatcttaataactgctctgatctgcggctgttttcaggggccaaggggacagggtgtcccctcctctccagtaagtagtaaacaggagtggtggcctgaagagatcacaggctaggatttggaggagctgtcctggtttgggtactgcctagctgggaggttgcaagcaggtcaccctggcttagtgcccttggcttttaaccccaactgccctcttcccttctgaggacagtaataaaaaataaaaatggagtgatcttagccacataccttggggtggctgtgcagagccataaagatgaaagaaaggcctgcctgtctccctccttccttcctttccttgtttaaaaaaaaaaaa

SEQ ID NO: 297814 - DNA, 8134 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaaagcaggtgcttcaggaagtagcaattgggagttgcatacagttacttcgtcagagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctggatcaaagaaagtgggtgtagtgcttagtctgttgtgtggaagagggcacctcctgggctttcgtggctggagactgtctaccaacattccttccttcaaactagacaaaccctcctctgccacccccagcaaattctcagaggtttccaagctgtagaaaaaggaaggaaggaaggacggcattcacatagctttactttccgcttcaaaatgtcttaagtagcatatgttgttttactgcttttaactttggtgagttctaatttcagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacattt

SEQ ID NO: 297815 - DNA, 8080 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctggatcaaagaaagtgggtgtagtgcttagtctgttgtgtggaagagggcacctcctgggctttcgtggctggagactgtctaccaacattccttccttcaaactagacaaaccctcctctgccacccccagcaaattctcagaggtttccaagctgtagaaaaaggaaggaaggaaggacggcattcacatagctttactttccgcttcaaaatgtcttaagtagcatatgttgttttactgcttttaactttggtgagttctaatttcagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacattt

SEQ ID NO: 297816 - DNA, 7447 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacattt

SEQ ID NO: 297817 - DNA, 7583 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaaagcaggtgcttcaggaagtagcaattgggagttgcatacagttacttcgtcagagaaaggagcgcccagtatgacaggcccccacccctgatccggccactgtgcacaggtcgctgagggtgtgagaacacctctgcaggggctccggcacatgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacattt

SEQ ID NO: 297818 - DNA, 7641 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctgccacccccaaagtcctcccacgtgctccatctcgctcgccctcctcccctcctccctcctcccccacacccagcacccccctccccatcctcacctgcgtccctccacccccacccgcccccctccctcccactcccaccgcgcccctcctcctcctcgcccgccccccacccccgccgcctcccccgctctcccccccctccctccctccctcctcctcccctatgccgtaccctccaccttcaccccccccctgcccctccccc

SEQ ID NO: 297819 - DNA, 7961 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagaggggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaaagcaggtgcttcaggaagtagcaattgggagttgcatacagttacttcgtcagagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctggatcaaagaaagtgggtgtagtgcttagtctgttgtgtggaagagggcacctcctgggctttcgtggctggagactgtctaccaacattccttccttcaaactagacaaaccctcctctgccacccccagcaaattctcagaggtttccaagctgtagaaaaaggaaggaaggaaggacggcattcacatagctttactttccgcttcaaaatgtcttaagtagcatatgttgttttactgcttttaactttggtgagttctaatttcagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacattt

SEQ ID NO: 297820 - DNA, 4423 bp, Homo sapiens
  misc_feature (15)..(15): n is a, c, g, or t
aacccccaacccttncccgccagaacgccctccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcccgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaaagcaggtgcttcaggaagtagcaattgggagttgcatacagttacttcgtcagagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctggatcaaagaaagtgggtgtagtgcttagtctgttgtgtggaagagggcacctcctgggctttcgtggctggagactgtctaccaacattccttccttcaaactagacaaaccctcctctgccacccccagcaaattctcagaggtttccaagctgtagaaaaaggaaggaaggaaggacggcattcacatagctttactttccgcttcaaaatgtcttaagtagcatatgttgttttactgcttttaactttggtgagttctaatttcagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctgagatttgtaagacattt

SEQ ID NO: 297821 - DNA, 421 bp, Homo sapiens
caggtcagggggtcttcgcctacttggttggcttgctttgtgaaggtcattgtttgtgttcttggatgttgattagaaaattaataggaaaaatgcatttagaaaccaaaaggcagaaatgagcttttctcctgttctttcctttttctcacccaggggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaa

SEQ ID NO: 297822 - DNA, 592 bp, Homo sapiens
atgaacatgaagccggccactgcctctgctctgctcctgctcctgctgggcctggcctggacccaggggagccacggctggggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297823 - DNA, 658 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 297824 - DNA, 636 bp, Homo sapiens
ccacaaacacacacaacaccacacacaccctaggctagtacgagctggtgtttaatcggccgaggcacaggctaaagagtgggaagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagtgccgggtgcatggtatggcatggaggtggcagctgtatcgttccatgatctactgatttcttaccttgctatgctgtatccgcacttgcctatgtgtgggatcgtacttcagttcttagtacccctgtctacagggtgggagctctcatcctttcttccttcggcttcccggtgtgtcttcctgtgcctgtctgctggtggtgtgaaagttctgggcatggcaagtttctt

SEQ ID NO: 297825 - DNA, 318 bp, Homo sapiens
tctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagaagtcagctgctgattttggaaacatccttctgactccgcctatgacgtctacatgatgttccctc

SEQ ID NO: 297826 - DNA, 1435 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297827 - DNA, 1181 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297828 - DNA, 1241 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297829 - DNA, 1252 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297830 - DNA, 1393 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297831 - DNA, 1453 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297832 - DNA, 666 bp, Homo sapiens
  misc_feature (9)..(9): n is a, c, g, or t
  misc_feature (35)..(37): n is a, c, g, or t
  misc_feature (49)..(49): n is a, c, g, or t
gcagggggnagctagggagagagtttagtctaagnnnggcactccgatnaacagccccacgttcccccacacccggacccccctctacttcagccgactctgggtaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297833 - DNA, 1659 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtggtgagtggaggcaacactccaccttgggctgggaccatggtgtcacacaatcctcgcctcccctcctgccactcagatctcccgactctggctcacaaagtgggttcttctctcatcccatatctccttggttccatagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagggtgagtctctgtcctcaagttaccctgcagggcccttggtcccccttggccttgctcccgggatctgggcaatctgaaattctctttcactcctccattcaatggctttctcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297834 - DNA, 2007 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtggtgagtggaggcaacactccaccttgggctgggaccatggtgtcacacaatcctcgcctcccctcctgccactcagatctcccgactctggctcacaaagtgggttcttctctcatcccatatctccttggttccatagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagggtgagtctctgtcctcaagttaccctgcagggcccttggtcccccttggccttgctcccgggatctgggcaatctgaaattctctttcactcctccattcaatggctttctcagccgggtgcaggatggcaggaggtggcagctgtaacttccaaggtgagacatctaccatggacccgctgggttacgtcctggcacttcttttcttggtctcctaccctcacctcccaagtaacacttgaagagttggcagaggtcttgagggcaggaggaggagtaggaggaggaggcggcggccatttgggctaggacagtaaaggcaggtgagggtgggggccctggctggctggaggagattgtataaaagaaaacacgtgacacaaggaggggagaaggcaggtgttttaggaaaggtctggtccaggcaggaaggtgggatgtttattccagagcaaaatggccttcgtccgtctgttctaaccgccatgcccacttcttccacagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297835 - DNA, 1258 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297836 - DNA, 1359 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297837 - DNA, 1248 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297838 - DNA, 1373 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297839 - DNA, 1276 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297840 - DNA, 1130 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297841 - DNA, 1172 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297842 - DNA, 1166 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggatttcaaacagaacactcctttcctcaactggaaagcaattattgagggtgcggacgcgtcatcactgcagaaacgtgcaggcagagccgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297843 - DNA, 1243 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccctaaaaaaatgccttaaatcaacatacgccaaaagaaaaaatatggcctcattggcctaacgggg

SEQ ID NO: 297844 - DNA, 2418 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggtatgctctgggtgcgtgctctaaaggtgataaggaagaggggacctcatggtggggtgtggagaaagacccataataaagtgatctagggctgggtgcagtggctcatgcctgtaatctctgtgctttgggaggctggggtgggaggatcacttgagtctgggagtttgagaccagactgggcaatatagcaagaccccatctctaaaagaacaaaacaaaacaaaccaaaacaaaacaaaccattccagcctgggaaacatggcaaaaccccgtctactaaaaatacaaaaaattagccaggtgaggtggtgcatgattgtaatcccagctactctggaggctgaggtgggagaatcacctgagcttgggaggttgaggctgctgcgaactgcgattgcaccgctgcactccagcctgggcaatcacagtgagaccttgtctcaaaacaaacaaacaaacaaatgaaaaaccttagccaggcatggtgacacatgcctgtagttctagctacttggaaggcagaggcaggaagatcgcttgagcccaggagttcaaaactgcagtgagctatgatcacaccattgcactccaagtctgggcaacagagggagaccctgtctggaaagaaagagagaaagagagagagagagaaagagggaaagaaagcaagcaagagagaaagaagaaagaaaatgacctaggaccctcggaaagcaccttagggtgggaccacataggcacagctctgagaagatggtgttctagatggagcacagggaccgggatagagatgttacaggggaactgtggagaaaagagcctcctggtggaagggttcagaggtgggacgcagcgaggctgcatgggcgagaggtgatagcttggctcggcagaaccacaaactctgttttaggcggagcaaaagtgaggggcaccacaggcgaacaggtaggacagcaaaagaatggtgggtgcccagacgctgggtgaaaagatgccccgtttccgcaggcttaggagtggccacgtgctaccatttgattttctttcttctaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297845 - DNA, 1073 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297846 - DNA, 1394 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 297847 - DNA, 1425 bp, Homo sapiens
  misc_feature (1404)..(1404): n is a, c, g, or t
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccctaaaaaaaaaanaaaatagagcctgttgggctt

SEQ ID NO: 297848 - DNA, 819 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaaaaaaaaaaaaaaaaaaaaaggggggggc

SEQ ID NO: 297849 - DNA, 1069 bp, Homo sapiens
attttagtggggcatagacttgtagtttgtgtgattgtgtttgaaacatattatgaagttagcacaataagaaatggatgattttaatattggttatgtgatgtatatgttcgcgtgatatttgatttttattagttgtttattaatattagtatttatctttgttgttgtttcagttgtattctttttttatgttttgtgtttttattttttatttattgtgttttttgtttttttttttgtgtttttttttttttttttgttttgtttccctcggcacacctggccttctccatgctcggaataacttcctgcagcgaccaacaggctaaagagggggaaggtctagggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtggtgagtggaggcaacactccaccttgggctgggaccatggtgtcacacaatcctcgcctcccctcctgccactcagatctcccgactctggctcacaaagtgggttcttctctcatcccatatctccttggttccatagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaaaaaaaaaaaaaaaaaaaaaggggggggc

SEQ ID NO: 297850 - DNA, 668 bp, Homo sapiens
ctggaaaagtttcttgtaaagccccggctcttagagccaggctggcaacctttgatatgcaaatgtaagccattagaaaccaggtccacccaggccaggtgtggtggctcacgcctgtaatcccaacactttgggaagcctaggcaggtggatcacctgaggtcaggagttcgagaccagcctggccaacatggtgaaaccccgcctctaataaaaacacaaaaaactagccaggtgtgctgctgtgtgtctgtaatcccagctacttgggaggctgaggcaggagaactgcttgaacccaggaggcagaggttgcagtgagctgagattgcatcattgcactccagcctgggcgacagcaagactctgtcaaaaaaaaaaaaaaaaaaaaaaaaacagccaggcgtggtagcacgcctgtagtcccagctacttgggaggctgagatgggaggatcaccctcgactggggaagttgaggctgcagtgagctgaaatcgcaccactgcactccagcctgggtgacagactgagaccctgtcaaataaataatgtatgtatgtatatatgtatgtatgtatgttaacctcatcccaaaacatcctcacagaacatccagaataatgtttgaccaaatatctgggcaccaatggcacattcaagttgaca

SEQ ID NO: 297851 - DNA, 254 bp, Homo sapiens
gtccttgggaagttttcattttttaaagcatctctggaaaagtttcttgtaaagccccggctcttagagccaggctggcaacctttgatatgcaaatgtaagccattagaaaccaggtccacccaggccaggtgtggtggctcacgcctgtaatcccaacactttgggaagcctaggcaggtggatcacctgaggtcaggagttcgagaccagcctggccaacatggtgaaaccccgcctctaataaaaacaca

SEQ ID NO: 297852 - DNA, 680 bp, Homo sapiens
caatatgttcattacagtgctattcttactagcaaggacacagaatcaacctaagtgcccagcaacactgaattgaatgaaaaaaatgtggtacataaacaccatggaaatctatgcagccaccaaacacagcaaaatcatgtccttttcagcaacatggatggaactagaggctattatcctaagcaacctaatgcaagaacagaaaactacatactgcatgttcccattggaaagtggcagctacacattgaattcacatgaaccagaggcactggagatcactagacaggtgagacaggaggggcacctgggctgaaaaaccacctgttgggtaccatgcttactgtttgagtgatgagatcattgggacaccaagcctcagccttccaaaatctacccatgtaacaaacctgtatgtgtaccctttaatctataataaaggttaaaattaaagattcgtaagtaaaataaaatgacatagagccctccaaaaaatggggttaactgagtggaacgagagaactttgcactatgaacgctaacccagatcaaaaactaaactctagtcatttaaaataatcgtaagttgtatatgatgataattgtataaaagttatacgtgaaagtgccaaaccctaaaattaaacactgtataatgaaattataaaaaatttcca

SEQ ID NO: 297853 - DNA, 161 bp, Homo sapiens
gcggccgcctactactactactgctcgaattcaagcttctaacgatgtacgggctcatgcctgggaagtgttgtggtgggggctcccaggaggactggcccagagagccctgagatagcggggatcctgaactggactgaataaaacgtggtctcccactg

SEQ ID NO: 297854 - DNA, 530 bp, Homo sapiens
cgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 297855 - DNA, 1806 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297856 - DNA, 462 bp, Homo sapiens
aggccaagaattgggcaagaggctggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 297857 - DNA, 790 bp, Homo sapiens
  misc_feature (597)..(598): n is a, c, g, or t
cgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtagcacaaaaaaaaaaaaaaaaaaaaaaaaaaaaactttttgggcggcctgggcccggaaaagtttttnnaaaccccatccgtttgggggcgcggcccacgtggtttcgggacactgggcccaacgcggtcccaagggaaaccggctcacaggggttgggttctccccaataaaaaacccggggccacgggcgttttgacaatccgaggcgctctggggcttcgggtcttcacggaccaagagtgataatccccgggggggg

SEQ ID NO: 297858 - DNA, 3262 bp, Homo sapiens
  misc_feature (1481)..(1481): n is a, c, g, or t
  misc_feature (1502)..(1502): n is a, c, g, or t
  misc_feature (1510)..(1511): n is a, c, g, or t
  misc_feature (1516)..(1516): n is a, c, g, or t
  misc_feature (1521)..(1521): n is a, c, g, or t
  misc_feature (1528)..(1528): n is a, c, g, or t
  misc_feature (1532)..(1532): n is a, c, g, or t
  misc_feature (1534)..(1535): n is a, c, g, or t
  misc_feature (1537)..(1537): n is a, c, g, or t
  misc_feature (1539)..(1539): n is a, c, g, or t
  misc_feature (1541)..(1541): n is a, c, g, or t
  misc_feature (1550)..(1550): n is a, c, g, or t
  misc_feature (1552)..(1552): n is a, c, g, or t
  misc_feature (1595)..(1595): n is a, c, g, or t
  misc_feature (1614)..(1614): n is a, c, g, or t
  misc_feature (1616)..(1617): n is a, c, g, or t
  misc_feature (1620)..(1620): n is a, c, g, or t
  misc_feature (1629)..(1630): n is a, c, g, or t
  misc_feature (1649)..(1649): n is a, c, g, or t
  misc_feature (1652)..(1652): n is a, c, g, or t
  misc_feature (1659)..(1660): n is a, c, g, or t
  misc_feature (1664)..(1664): n is a, c, g, or t
  misc_feature (1679)..(1680): n is a, c, g, or t
  misc_feature (1691)..(1692): n is a, c, g, or t
  misc_feature (1698)..(1698): n is a, c, g, or t
  misc_feature (1709)..(1709): n is a, c, g, or t
  misc_feature (1713)..(1713): n is a, c, g, or t
  misc_feature (1718)..(1718): n is a, c, g, or t
  misc_feature (1721)..(1721): n is a, c, g, or t
  misc_feature (1731)..(1731): n is a, c, g, or t
  misc_feature (1735)..(1735): n is a, c, g, or t
  misc_feature (1749)..(1749): n is a, c, g, or t
  misc_feature (1761)..(1761): n is a, c, g, or t
  misc_feature (1764)..(1765): n is a, c, g, or t
  misc_feature (1769)..(1770): n is a, c, g, or t
  misc_feature (1772)..(1772): n is a, c, g, or t
  misc_feature (1774)..(1774): n is a, c, g, or t
  misc_feature (1777)..(1778): n is a, c, g, or t
  misc_feature (1781)..(1781): n is a, c, g, or t
  misc_feature (1784)..(1784): n is a, c, g, or t
  misc_feature (1788)..(1788): n is a, c, g, or t
  misc_feature (1790)..(1790): n is a, c, g, or t
  misc_feature (1793)..(1793): n is a, c, g, or t
  misc_feature (1795)..(1797): n is a, c, g, or t
  misc_feature (1806)..(1806): n is a, c, g, or t
  misc_feature (1808)..(1808): n is a, c, g, or t
  misc_feature (1813)..(1813): n is a, c, g, or t
  misc_feature (1816)..(1816): n is a, c, g, or t
  misc_feature (1824)..(1824): n is a, c, g, or t
  misc_feature (1843)..(1845): n is a, c, g, or t
  misc_feature (1850)..(1850): n is a, c, g, or t
  misc_feature (1853)..(1853): n is a, c, g, or t
  misc_feature (1858)..(1858): n is a, c, g, or t
  misc_feature (1864)..(1864): n is a, c, g, or t
  misc_feature (1867)..(1867): n is a, c, g, or t
  misc_feature (1877)..(1878): n is a, c, g, or t
  misc_feature (1886)..(1886): n is a, c, g, or t
  misc_feature (1899)..(1899): n is a, c, g, or t
  misc_feature (1902)..(1902): n is a, c, g, or t
  misc_feature (1907)..(1908): n is a, c, g, or t
  misc_feature (1915)..(1915): n is a, c, g, or t
  misc_feature (1921)..(1921): n is a, c, g, or t
  misc_feature (1923)..(1925): n is a, c, g, or t
  misc_feature (1930)..(1930): n is a, c, g, or t
  misc_feature (1944)..(1944): n is a, c, g, or t
  misc_feature (1948)..(1948): n is a, c, g, or t
  misc_feature (1951)..(1951): n is a, c, g, or t
  misc_feature (1953)..(1953): n is a, c, g, or t
  misc_feature (1957)..(1957): n is a, c, g, or t
  misc_feature (1960)..(1960): n is a, c, g, or t
  misc_feature (1967)..(1967): n is a, c, g, or t
  misc_feature (1972)..(1972): n is a, c, g, or t
  misc_feature (1985)..(1986): n is a, c, g, or t
  misc_feature (1990)..(1991): n is a, c, g, or t
  misc_feature (1995)..(1995): n is a, c, g, or t
  misc_feature (2000)..(2001): n is a, c, g, or t
  misc_feature (2004)..(2005): n is a, c, g, or t
  misc_feature (2010)..(2010): n is a, c, g, or t
  misc_feature (2016)..(2016): n is a, c, g, or t
  misc_feature (2027)..(2028): n is a, c, g, or t
  misc_feature (2030)..(2030): n is a, c, g, or t
  misc_feature (2032)..(2033): n is a, c, g, or t
  misc_feature (2035)..(2036): n is a, c, g, or t
  misc_feature (2040)..(2040): n is a, c, g, or t
  misc_feature (2057)..(2057): n is a, c, g, or t
  misc_feature (2070)..(2071): n is a, c, g, or t
  misc_feature (2076)..(2076): n is a, c, g, or t
  misc_feature (2078)..(2078): n is a, c, g, or t
  misc_feature (2543)..(2544): n is a, c, g, or t
  misc_feature (2547)..(2548): n is a, c, g, or t
  misc_feature (2565)..(2565): n is a, c, g, or t
  misc_feature (2573)..(2573): n is a, c, g, or t
  misc_feature (2576)..(2576): n is a, c, g, or t
  misc_feature (2579)..(2580): n is a, c, g, or t
  misc_feature (2604)..(2604): n is a, c, g, or t
  misc_feature (2612)..(2612): n is a, c, g, or t
  misc_feature (2615)..(2617): n is a, c, g, or t
  misc_feature (2619)..(2619): n is a, c, g, or t
  misc_feature (2631)..(2631): n is a, c, g, or t
  misc_feature (2634)..(2634): n is a, c, g, or t
  misc_feature (2640)..(2640): n is a, c, g, or t
  misc_feature (2643)..(2643): n is a, c, g, or t
  misc_feature (2649)..(2649): n is a, c, g, or t
  misc_feature (2651)..(2651): n is a, c, g, or t
  misc_feature (2653)..(2653): n is a, c, g, or t
  misc_feature (2658)..(2659): n is a, c, g, or t
  misc_feature (2661)..(2661): n is a, c, g, or t
  misc_feature (2671)..(2671): n is a, c, g, or t
  misc_feature (2674)..(2674): n is a, c, g, or t
  misc_feature (2684)..(2684): n is a, c, g, or t
  misc_feature (2696)..(2696): n is a, c, g, or t
  misc_feature (2698)..(2698): n is a, c, g, or t
  misc_feature (2702)..(2703): n is a, c, g, or t
  misc_feature (2708)..(2709): n is a, c, g, or t
  misc_feature (2712)..(2713): n is a, c, g, or t
  misc_feature (2715)..(2717): n is a, c, g, or t
  misc_feature (2742)..(2742): n is a, c, g, or t
  misc_feature (2744)..(2744): n is a, c, g, or t
  misc_feature (2749)..(2751): n is a, c, g, or t
  misc_feature (2754)..(2754): n is a, c, g, or t
  misc_feature (2756)..(2759): n is a, c, g, or t
  misc_feature (2763)..(2764): n is a, c, g, or t
  misc_feature (2766)..(2766): n is a, c, g, or t
  misc_feature (2768)..(2770): n is a, c, g, or t
  misc_feature (2790)..(2790): n is a, c, g, or t
  misc_feature (2792)..(2792): n is a, c, g, or t
  misc_feature (2808)..(2810): n is a, c, g, or t
  misc_feature (2822)..(2822): n is a, c, g, or t
  misc_feature (2836)..(2836): n is a, c, g, or t
  misc_feature (2841)..(2841): n is a, c, g, or t
  misc_feature (2843)..(2844): n is a, c, g, or t
cgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagaatgcttaggtgaaaggttgttaaggagaaatatatttactgaagctgtctgaagacagatgacgcttttcgattctgcaccttgtatagctcctggagttggagctggaagagaaggcctttgaaagcaagaaactttggtaccttctggccagctcccagggaaggtttgaggggaacaggcaaatttgggctgatgttttgcatctattcgctgggaggcggtccttgttcccaccagaagaagcagcaggaccaagttcactatggagttctgatgtgaagttaactcaatattagagaattctacttatttgagggaattgtgaagagcctaaatactagaggcaccaaatatctatggcagcaggaatcctgaccaaatcagaataactgttagattatttcctgtttggaataattcttgttcaattgctcatgtaatcaagaattgatgattcagttatttatggagaattaagtttataaagcaaattaagtgtcaaggccagattacttaaggaatgccacgtgctcagaaattcacagcagatgcaatctcatgtaaaaccctcatgtggtaaaacaaagatctatcatggttgcccttaatcttttctctttttttttttttttttttttgagacaaggctttactctgtcgcttaggctggagtgcagggatgtgatcactgaagccttgacctggtctcaagcaatcttccctcctcagtcttaccagtagctgggactaccagtgagtgccaccacacccagctactgttttaagtttttgtagagatggggtttcaccacattgcccaggctggtctcgaactcctgggctcaagtgatcctcctatttcagcctcccagagtgctggaattacaggtgtgagccactgtgcctggctgccctcatttctttgcccccctctaggacttgctttctccgcatagcccttttgcaggcttcagagttctttccatccagtagccccgggacttctctctgttagattttgtttccatatgtattaccttcacttgcttcttttttttnttttttttgagatggagtctngctctgtnncccangctgnagtgcantggngnnancncngctcactgnancctctgcctcccaggttcaagcgattctcctgcctcagcctcncgagtagctgggattacangnntgngccaccatnnctggctaatttttgtattnttngtagagnnaggntttcaccatgttggnnaggctggtctnnaactcntgaccttgtgntccncccgnctnggcctcccanagtnctgggattacaggngtgagccactgngcnnggcnntncngtnnctnctnaaananacnannngctgggtgngntggcncangcctgtantcctagcactttgggaggnnnaggcnggnggatngcttgngcncaggagttcnngaccagcntgggcaacatggnganacccnntctctcnaaaaanannnaaaanttagccgggcatgntggnacncncctntantcccagntactngggaggctgaggnnggannatcncttgnnccnnggagncaaggntgcagtgagcnnananngnnccantgcactccagcctgggngacagagtgagannctgcntnaaaaataaaaaaaaataataaaaaaagaaaagatgccattgtggtggggcaaagttcttggcccactttgccttctctgccctctccacctgggcaggtggggccctgtttgtctttgcttttgtcctctcaccttctctcccatcatattccaggtaacctaaaatcctttcctgcccccatgaagaagtagatccaagcactctgccctccaacctgtgtccagggagcaaggccttcaacttccaccactggtcacccagcttaatgaattgactctcattgtctggcttcttttggaaagggtttaactgggttccccaaatgggaacacaccttgcccttcagactctgttgtccatcacctttccttttcccttttatgggaggaaagccagggtagggaagttatgtgagatttggggcagagctggtaaaaaaaagcatacatctacatccatgttnnttnnttttttttttttttttngagacggngtntcnntctgttgcccaggctggagtgcantggtgcgntcnnngntcactgcaactntgncttccnggntcaagngntnctccnncntcagcctccngantagctgggantacaggcatggnancacnntactnnctnntnnnttttttttttaattttttttttttntnaagannnggntnnnncttnntngnnnaggctggtctcaaactcctngnctcaagtgatctgccnnnctcagcctcccnaagtgctgggattncaggngnnagccaccacactcaacctcctacctccatgttctgggtatcattaaggtaatcagaatcctcctgctgtagtcacgcttacccttctaagcaggttccccaggattcagagagccccggatttctcctggactccatgtgcagatgcctagtatttccattctgaccgttgccctccttgttcttcttgcctccctagttctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 297859 - DNA, 587 bp, Homo sapiens
cgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaagatttactcatcggccaagatttactcatcggccaagatttactcatcggccaagatttactcatcgaccaagatttactcatcgaccaagatttactcatcggccaagattactcatcg

SEQ ID NO: 297860 - DNA, 1117 bp, Homo sapiens
  misc_feature (924)..(925): n is a, c, g, or t
cgctgacgcatgcgcatagctaaccgcacccggttcagctcgcctttcttggccagaggcgccggttggactcacgggcggggcatgatggaacaggaccggtggggtccccaggaagtcctagagggggtcggggtttgggtggacaagctttcctcgtcctctcccgacagagctgacgtgtcctgggttccaccgggagcgggcatttccaccggacgggagggttcggggtgtccggggctggggaatacgtaggggttgccgcgcggtgtggggagttggggcgtgtggctgcagtcccgggagttcttggagggggtcggcccaccgagcttccggaccggctgatctgcccgtagcttgccggagggagggcggagcctgactctccgtcccttctcccatcccctccagttggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtagcacaaaaaaaaaaaaaaaaaaaaaaaaaaaaactttttgggcggcctgggcccggaaaagtttttnnaaaccccatccgtttgggggcgcggcccacgtggtttcgggacactgggcccaacgcggtcccaagggaaaccggctcacaggggttgggttctccccaataaaaaacccggggccacgggcgttttgacaatccgaggcgctctggggcttcgggtcttcacggaccaagagtgataatccccgggggggg

SEQ ID NO: 297861 - DNA, 378 bp, Homo sapiens
cgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctccgtgccccgtggcctcttgaacggccaacaccgggcggtaaacaccgctcaatctcagggggg

SEQ ID NO: 297862 - DNA, 1895 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297863 - DNA, 1991 bp, Homo sapiens
gtcgctctagaggacccctcataggttcgcagggccatgagccaaggcctatgggcagagagaaggaggctgctgcagggaaggaggcggccaacccaggggttactgaggctgcccactccccagtcctcctggtattatttctctggtggccagagcttatattttcttcttgctcttatttttccttcataaagacccaaccctatgactttaacttcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297864 - DNA, 1864 bp, Homo sapiens
ggtagcgcaagcagaacacagaccagcaccagcagcgcgatgccccagccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297865 - DNA, 1775 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297866 - DNA, 1123 bp, Homo sapiens
gaattgagaatggagtgctcttgctggctggggttgtggtagccctggcagaggtgccgttgtgcaccagagtagaagctgagcctgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297867 - DNA, 1146 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297868 - DNA, 1200 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297869 - DNA, 1173 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297870 - DNA, 1071 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297871 - DNA, 1992 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcgtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 297872 - DNA, 1879 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgaaaagacataaaaaaagaaaaagacaaagacgagcaaaaagacaaaaagaggcaaaaacaacaaaacacaacaaacaaaaaaaagcacacacaaaaaaaagaag

SEQ ID NO: 297873 - DNA, 1582 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297874 - DNA, 2792 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtgagattgggccccacaggccaggggaagcagagggtttggctgggcaaggattctgaagggggtacttggaaaacccaaagagcttggaagaggtgagaagtggcgtgaagtgagcaggggagggcctggcaaggatgaggggcagaggtcagaggagttttgggggacaggcctgggaggagactatggaagaaaggggccctcaagagggagtggccccactgccagaattcctaaaagatcattggccgtccacattcatgctggctggcgctggctgaactggtgccaccgtggcagttttgttttgttttgcttttttgcacccagaggcaaaatgggtggagcactatgcccaggggagcccttcccgaggagtcccaggggtgagcctctgtgcccctaatcatctcctaggaatggagggtagaccgagaaaggctggcatagggggaggtttcccaggtagaagaagaagtgtcagcagaccaggtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297875 - DNA, 1638 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297876 - DNA, 1542 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297877 - DNA, 1850 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggaatggagggtagaccgagaaaggctggcatagggggaggtttcccaggtagaagaagaagtgtcagcagaccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297878 - DNA, 1653 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297879 - DNA, 2252 bp, Homo sapiens
  misc_feature (2059)..(2060): n is a, c, g, or t
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcgtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtagcacaaaaaaaaaaaaaaaaaaaaaaaaaaaaactttttgggcggcctgggcccggaaaagtttttnnaaaccccatccgtttgggggcgcggcccacgtggtttcgggacactgggcccaacgcggtcccaagggaaaccggctcacaggggttgggttctccccaataaaaaacccggggccacgggcgttttgacaatccgaggcgctctggggcttcgggtcttcacggaccaagagtgataatccccgggggggg

SEQ ID NO: 297880 - DNA, 1460 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297881 - DNA, 2101 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcgtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 297882 - DNA, 1931 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcgtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagcaggaggagggggatcctcagagc

SEQ ID NO: 297883 - DNA, 639 bp, Homo sapiens
agtcgtgacgtggcacaaccctggcgctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297884 - DNA, 2391 bp, Homo sapiens
  misc_feature (2198)..(2199): n is a, c, g, or t
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcgtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagaatgcttaggtgaaaggttgttaaggagaaatatatttactgaagctgtctgaagacagatgacgcttttcgattctgcaccttgtatagctcctggagttggagctggaagagaaggcctttgaaagcaagaaactttgttctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtagcacaaaaaaaaaaaaaaaaaaaaaaaaaaaaactttttgggcggcctgggcccggaaaagtttttnnaaaccccatccgtttgggggcgcggcccacgtggtttcgggacactgggcccaacgcggtcccaagggaaaccggctcacaggggttgggttctccccaataaaaaacccggggccacgggcgttttgacaatccgaggcgctctggggcttcgggtcttcacggaccaagagtgataatccccgggggggg

SEQ ID NO: 297885 - DNA, 885 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactg

SEQ ID NO: 297886 - DNA, 1278 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgctgtgattggaggaggtgagaggaggtaccgtgctatggtgagtgctactggcatcagtcttggtgctatggctggcaagggtggtaggagtatcagagtggtggctgggaattgagaatggagtgctcttgctggctggggttgtggtcgac

SEQ ID NO: 297887 - DNA, 1025 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcagccaggagctgtggtggcagaataagcgatcctctaatca

SEQ ID NO: 297888 - DNA, 793 bp, Homo sapiens
ccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctgcgcccggcaggcccacggtgtcacctcggccccggacaccaggccggccccgtgtcaaatggaatgatagaaatgaagcagactccccacctactgtgctaactgggtatgcaacagtttaatgaaataccataagccttaggttggagactgtgatggaacagcgtagaggccatccgtttccaggccattctgagatccaagatgccaactc

SEQ ID NO: 297889 - DNA, 1923 bp, Homo sapiens
gcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactgattgtgaaaaatgagaaaattttatcttggctgatagggatgaaaagttccagcacttgggagaaaaatatggtggtggtgggctagcttatatgttatctactgtgagtattcagctgacagctggcataatttcacagagcctatttggattcactgaaaagggtcattccagggacaatattgtttc

SEQ ID NO: 297890 - DNA, 680 bp, Homo sapiens
  misc_feature (680)..(680): n is a, c, g, or t
gcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagataaaggcctacctgaaggttcgctcatccccaggacttcgagggcaatgccatcttcacctcccctactccagtggagtgtgctgggccn

SEQ ID NO: 297891 - DNA, 522 bp, Homo sapiens
caggctcacacagcaagtctttgtcaaagcttaggaatggaagtaggttgtcccctcctagtcatgggatctctccaactcactagacaatcttgctttacgtgctgatgaacatgctctgtgagcagcctggcttccctttcagcatcctcctgactgaagtcgccccatctctcttgctgcaggtacatttttttgtgttatttcttacaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297892 - DNA, 711 bp, Homo sapiens
caggctcacacagcaagtctttgtcaaagcttaggaatggaagtaggttgtcccctcctagtcatgggatctctccaactcactagacaatcttgctttacgtgctgatgaacatgctctgtgagcagcctggcttccctttcagcatcctcctgactgaagtcgccccatctctcttgctgcaggtacatttttttgtgttatttcttacaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactgattgtgaaaaatgagaaaattttatcttggctgatagggatgaaaagttccagcacttgggagaaaaatatggtggtggtgggctagcttatatgttatctactgtgagtattcagctgacagctggcataatttcacagagcctatttggattcactgaaaagggtcattccagggacaatattgtttc

SEQ ID NO: 297893 - DNA, 992 bp, Homo sapiens
gcctccgcccggatggcaggcgggcggggccccagtccaggccttgagacccagaagggagcgaaggtttttgctgcgccaacgcagtgaccgaaggctccgctcacgcccgggtaagaggcatccgcggccgatctttggccctgggccagcggagggagactgggcggggacagcgaccaccactgaggctgtttgttagcttaactcggtttccgcagctgggactccgcagacccggtgcgccgcgccccaaactttgcttcctcaactccggacacctgcagctcttgctgcccttgtctggaacccgggtcttgggactcttgcttccttctcagagtgtcagagcctcagggccgcggagaggccaacccgcgaggggtgcttaaaaaccgaagtatccgtggtcttggtgtgtggacgtttctggcgccttccacctgttgactgtcactcggcaccgtcctggagcgggagtgggtgctcggcgtccgggggccagggattgacacagtcatccaccgacactgcgcgtgggacagagggggcgctcgaggggtcggctgcagctgaaacctgaaggggagaggatttagggcacctgctgaacaggaattggtggaaagggagaaggggtcttctggtggaatctgggctcatttcctttcctcttcatctgtctcttttatttatcaaaattccaacctggctttttgctcaaagacgctgaacagagcccctggctttgcctgcgctgcccattgctataatgcagggctctgttccatttttgtgctgtgcacccctttggcatttctgggaaggctaaagactctcagaacaatacttttttttgagacagagtcttgctctgtcgcccaagctggagtgcagtggcgcgatctcggctcactgccacctccacctcccgggttcaagcgattctcctgcctcagcctgccgagtaactgggattacaggcgcagcac

SEQ ID NO: 297894 - DNA, 516 bp, Homo sapiens
tacccatgcccccctagcgggaggacaatttctgtaattatgaagaatcaatctctaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggtaagtgcactgcctggttcctggatgaggaaagggatttgtagcacatctccacccaaaggggatgcagcctcttttcttcattattagcagtgaccaagtgttctgtcttccatgctctaggcctgagccactgcacccagccactcttctgcattctaaaagctgatgacctcctttgacttttctaaacccatatgagagagaaatctgggtgtctacatcagtggtcctgaaccaagagtgatcttcctaccccttgctgccccag

SEQ ID NO: 297895 - DNA, 1734 bp, Homo sapiens
gcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297896 - DNA, 1796 bp, Homo sapiens
ttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297897 - DNA, 1679 bp, Homo sapiens
taagaagcgcctttcgcctccctccatgattctgaggcctccccagccacatggtactcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297898 - DNA, 1768 bp, Homo sapiens
taagaagcgcctttcgcctccctccatgattctgaggcctccccagccacatggtacttgtatgcctagacagcgggcacagggcttgctggacacagaaggcaaggactcagagaatatccaccagatgaaagaatgactgcatgacctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga
